United States Patent 9,958,448 (APTAMERS AND USES THEREOF) - sequence listing, part 4

SEQ ID NO: 39331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgggacttcggcgtcttggagccgggttg

SEQ ID NO: 39332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgggcaagcacgtgctgcgaaattggggc

SEQ ID NO: 39333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggggacgtcagtgggtatatccttagcg

SEQ ID NO: 39334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgggggtcttctagtctggcgggcctgag

SEQ ID NO: 39335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgggtactgacgcttagcccagcatcctc

SEQ ID NO: 39336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggtattgagcccggttcatgacatcgtc

SEQ ID NO: 39337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggtcaaaatttacgataagagatttggt

SEQ ID NO: 39338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtggtgcgccggagtttgttcttctcgacg

SEQ ID NO: 39339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtagtccacgaggacacgcctgtacgag

SEQ ID NO: 39340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtcaatggtatagtgatcaactttgctc

SEQ ID NO: 39341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtctaacgcggagcaatctccattgtcg

SEQ ID NO: 39342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtgaaaccattcgaactgctctttatcg

SEQ ID NO: 39343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtgaatttccggacgaacacgttctgcg

SEQ ID NO: 39344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtgcattaacagtcggcgttatgacgta

SEQ ID NO: 39345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgtgtgagaggttaaagggtggctggcta

SEQ ID NO: 39346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtgttgccgtagcgcagcgtaaggggtgat

SEQ ID NO: 39347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttaaagccgaccgctcaagaacggacgct

SEQ ID NO: 39348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttaccagtgttcagacgtcctgcggacgc

SEQ ID NO: 39349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttacggttgtgggtggtctcgattatagg

SEQ ID NO: 39350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttataggatactcgtacgggccttagcta

SEQ ID NO: 39351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttatcacgcgatgccgtgctctcctcccg

SEQ ID NO: 39352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcactcgagctcgagcccttcagtttag

SEQ ID NO: 39353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcagagggtttcacgtacgctgtaaaaa

SEQ ID NO: 39354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcagctctctttgggtagaagctaatcc

SEQ ID NO: 39355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcatacgctgcgtgcggagggagagtgg

SEQ ID NO: 39356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttccagtgggcataggcaaaccaccgtcc

SEQ ID NO: 39357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcctccttgtctcgcctccgccctcgtc

SEQ ID NO: 39358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttccttgggcgtcagtatgcgcatcacct

SEQ ID NO: 39359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcgcgcggagggactgtatttgctgaat

SEQ ID NO: 39360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcggattctttataagatagccgtggag

SEQ ID NO: 39361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttcgggaatacattggggggtaggcttgc

SEQ ID NO: 39362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgaggtgacctatgcgtgttagaccgca

SEQ ID NO: 39363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgataccgtgatctttgctaaggacctc

SEQ ID NO: 39364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgattttagcatcagcttcatatgggcc

SEQ ID NO: 39365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgcacgaatgcggtcgcgcgatttcttg

SEQ ID NO: 39366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgccagcattcttggttcggcggtgtcg

SEQ ID NO: 39367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgccgtagtagatggtgactttcaggga

SEQ ID NO: 39368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttggaccatcggcggcggcaagtcctcgc

SEQ ID NO: 39369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttggagctacttcggtcccgtggcccggc

SEQ ID NO: 39370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttggcccggtcaatccatagccattaccg

SEQ ID NO: 39371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttggcgggtactccacgtgcggaccacgc

SEQ ID NO: 39372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgtaggacacataattccgtggccatcc

SEQ ID NO: 39373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgtctgtggtagccggggcgttgttttg

SEQ ID NO: 39374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttgtgcgcagagggcgtccctgtacgcaa

SEQ ID NO: 39375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttaccgcacaaggttgtccccgggcgtg

SEQ ID NO: 39376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttaggtgttcagcgggatcttgttagga

SEQ ID NO: 39377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttatcgggcttgtcaatcccgtgctcct

SEQ ID NO: 39378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttcataaggcctttgattgcgcgtggtc

SEQ ID NO: 39379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttcgacccgcttgattctagttcactgg

SEQ ID NO: 39380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttgcagacttgctacagtggtccggacg

SEQ ID NO: 39381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttgctcacagaatagatggcatcagtga

SEQ ID NO: 39382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagtttgtacattgcgcctacctgcaattatg

SEQ ID NO: 39383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gagttttatgtcgaagtagattagatagggca

SEQ ID NO: 39384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaaaaaagatcaggcccagtcggaacggt

SEQ ID NO: 39385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaaaaccgaatcatccgcactccctcggg

SEQ ID NO: 39386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaaaacggatcaagctacttcgtccagct

SEQ ID NO: 39387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaacaaatatacgggactaccgtaactat

SEQ ID NO: 39388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaacgccgttctgcgtggtgtgcgggttt

SEQ ID NO: 39389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaacgtttgtgtcaagctcgtaacggacc

SEQ ID NO: 39390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaactgagagctacgaggtaactgcaagg

SEQ ID NO: 39391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaagcgcgaggagagcggctacaggtacg

SEQ ID NO: 39392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaagctcaaaacgtatgtcctttgaatgc

SEQ ID NO: 39393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaagtgcgtgatgactcctgaaggtgacg

SEQ ID NO: 39394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaataacggacggttgtttggttacatca

SEQ ID NO: 39395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaccgcctctgtcatcgggctcgactgga

SEQ ID NO: 39396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaccttcttgaaagttcgtcgcttgcatg

SEQ ID NO: 39397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacgatgacctattcgggtgcaggtgggg

SEQ ID NO: 39398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacgcgtaagtgggcggcaacacttaggg

SEQ ID NO: 39399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacggcgcccatatcaacccaggctttcg

SEQ ID NO: 39400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacgggtatacggctcattcagcgtgggc

SEQ ID NO: 39401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacgggtgaccgttataatattctcggga

SEQ ID NO: 39402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacgggtttgcttatatggctcggctttc

SEQ ID NO: 39403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataacgttgttaacagcgcctgtggttagtg

SEQ ID NO: 39404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataactaattttgtatctggctcagcccgtt

SEQ ID NO: 39405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataactagcttgatactcgtaaccagtggtg

SEQ ID NO: 39406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagaaggtagtcaatatgaacacaagaag

SEQ ID NO: 39407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagacggctgccgtatcaaagtatatgct

SEQ ID NO: 39408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagactataaacgagcatcttctgtagcg

SEQ ID NO: 39409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagaggggacctacaatattgctatgcgc

SEQ ID NO: 39410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagcgaccggcccgtgatgtcttgaagat

SEQ ID NO: 39411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagcgagggaccagcaaatcagccttgtc

SEQ ID NO: 39412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagcgatttgccgagctgttctgagcatg

SEQ ID NO: 39413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagctgagaactgagcatgtttggtctta

SEQ ID NO: 39414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaggaacagcaacggttcttgtcgttctg

SEQ ID NO: 39415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaggagcgaccatgaaatttatcacaggt

SEQ ID NO: 39416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataaggtacccaaatacgactcacgccggcg

SEQ ID NO: 39417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagtgccacccgacggctgacccctaggg

SEQ ID NO: 39418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataagttgcgcctcttaacagctcacttaaa

SEQ ID NO: 39419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataataccaggagacctcttcagttgcgtag

SEQ ID NO: 39420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataatatattatggtgctctcacgcagaaag

SEQ ID NO: 39421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataatatggtaaacatcaacgggttttatat

SEQ ID NO: 39422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataatcgccgcacattttgctagcagctccg

SEQ ID NO: 39423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataatgtgaattgcgggccgacgagttcgtt

SEQ ID NO: 39424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataattggagcatgacgggacgtgacacaaa

SEQ ID NO: 39425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacaaaccctacggaagcgatggaccgccg

SEQ ID NO: 39426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacaacattgtcgagttaatttactgacgt

SEQ ID NO: 39427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacaatacggataccttgtcaccctaagtt

SEQ ID NO: 39428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacacaacgcagggtcaatttagaatcgag

SEQ ID NO: 39429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacacccgacgcctacctcttcttgccggt

SEQ ID NO: 39430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacaccgcggggtagtaaaatgcgcgatgt

SEQ ID NO: 39431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacacctcattgaataattcacgtgctcct

SEQ ID NO: 39432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacagagtctctatggataaccccgcgggt

SEQ ID NO: 39433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacagccgatcaggaaacagtccggatgtc

SEQ ID NO: 39434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacaggcgcggtgatagagcgagcagacaa

SEQ ID NO: 39435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccaaaggatcggcctatattccggtggc

SEQ ID NO: 39436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccacctttatgcagtgtggggctgtgcg

SEQ ID NO: 39437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccacggctacgttacttggctcaatgtc

SEQ ID NO: 39438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccagctcttccctcgcgacctaggtgca

SEQ ID NO: 39439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacccgaaacgatggtgagcacagaagcgg

SEQ ID NO: 39440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacccgatcgtagagccctggtgttgtgct

SEQ ID NO: 39441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacccggacgaccaggtctttgcctgcaat

SEQ ID NO: 39442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacccgggagagacaatggcaggattgagt

SEQ ID NO: 39443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccgaatgattggcgtggaaattgccacg

SEQ ID NO: 39444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccgcgtgtatctcgactgcaaaggcgtt

SEQ ID NO: 39445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccggactagggcacgtgctgcaactttc

SEQ ID NO: 39446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccgggagcagaagatagcagtttacgga

SEQ ID NO: 39447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccgttcaagcgcatcattacgtaacacg

SEQ ID NO: 39448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacctccgcggggggatctggcccgtagcg

SEQ ID NO: 39449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacctgtgcacttgaagctcttccggtccc

SEQ ID NO: 39450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataccttgtccgaggcttgctacgtcctaga

SEQ ID NO: 39451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgagtagctgctttttcccgttatggcg

SEQ ID NO: 39452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgatgatgggccacgagatgctcgattc

SEQ ID NO: 39453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgcagtgcgtattaataagggcgcacat

SEQ ID NO: 39454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgcatgagttccgacagcgcactagacc

SEQ ID NO: 39455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgccatttccgttccgattccgcccact

SEQ ID NO: 39456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgcgggaggacggtcttcggcttggtgg

SEQ ID NO: 39457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgctcacaatgtaccgcgggttagtagc

SEQ ID NO: 39458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgggaggttcctgaagtcctccagagtt

SEQ ID NO: 39459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgggcctcaaagacatgcgcgaagggtg

SEQ ID NO: 39460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgggtgctgcaaaggacagggtcggtac

SEQ ID NO: 39461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgggtggtaggtccacgcaaaagggttt

SEQ ID NO: 39462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacggtcacggaacgaatgtgcatgggacg

SEQ ID NO: 39463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacggtcggtgtgcgtgccggtgtgaaatc

SEQ ID NO: 39464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgtcggcaacagacgcttttgatggcct

SEQ ID NO: 39465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgtctaactttgaacgtggcaagtgtgc

SEQ ID NO: 39466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgtgccttccgccttccttaggaccagt

SEQ ID NO: 39467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgtgcgttttggttcaacagggtggtcg

SEQ ID NO: 39468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgtggggacggtcttccggtcttatgtc

SEQ ID NO: 39469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacgtttctagcaatcttccgttttatggc

SEQ ID NO: 39470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactacagcaccggaccgccgtcagctggc

SEQ ID NO: 39471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactacgatttaggtgaagcgcatgtatcc

SEQ ID NO: 39472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactatgcaatctcgggcacggcagctaag

SEQ ID NO: 39473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactattattactagctatttacgcgggta

SEQ ID NO: 39474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactatttgcttaggatgtttaagtcggca

SEQ ID NO: 39475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactcctctgtcgttaggcgacggtggtcc

SEQ ID NO: 39476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactcgtagcactacttgttagatgacaca

SEQ ID NO: 39477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactcgtttggcttcgggactatcttccgg

SEQ ID NO: 39478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactgccagtagtgtttcagtttctatggt

SEQ ID NO: 39479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactgcggaggtgacggtggatttttcgtg

SEQ ID NO: 39480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactggctgagatcggcccacttgataggg

SEQ ID NO: 39481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactgttaaccagctgaaactttctacgcg

SEQ ID NO: 39482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacttattttgtgcagattagcgtatcgac

SEQ ID NO: 39483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacttcatttgttggcccgaatcgccgttt

SEQ ID NO: 39484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacttggagcttcctttatggtatgacagg

SEQ ID NO: 39485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatacttggaggcactacgacacaagccctgc

SEQ ID NO: 39486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatactttccttgcatcgtggagctatttaac

SEQ ID NO: 39487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagaacagctatgatactttcgcccggtcg

SEQ ID NO: 39488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagaactcgttactatcgtctgatgtggtg

SEQ ID NO: 39489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagaagcctgaaggaattcccgcttggatg

SEQ ID NO: 39490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagacattgggcctttcatttgaatccgta

SEQ ID NO: 39491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagactctctaagtcagccgcggactgaac

SEQ ID NO: 39492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagaggttataggcgatctctacttgcgaa

SEQ ID NO: 39493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagagtcgcgatgtttggtcgcacgccttt

SEQ ID NO: 39494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagataacaaagttaaacttcccgtaggtc

SEQ ID NO: 39495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagatcatccccggaggtggccgttaatcc

SEQ ID NO: 39496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagatcgggacgcaagttaccatcttgagt

SEQ ID NO: 39497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagatgggacacttctcgtaagcttacggc

SEQ ID NO: 39498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcaatgaataagaggctctatcgccagc

SEQ ID NO: 39499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcacatatatcgggttttcttcggcacc

SEQ ID NO: 39500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcagtacgcgaatcccctcctaggctgc

SEQ ID NO: 39501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagccaatggtaaacccctgtttacgcctg

SEQ ID NO: 39502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagccggcgccacgacattgggggcctagt

SEQ ID NO: 39503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagccggcgtgacatcgtgattcgtatgct

SEQ ID NO: 39504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagccgggtatcccatggcttcaaatggtg

SEQ ID NO: 39505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcctgactgcaacgcggcaacgctacgg

SEQ ID NO: 39506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcctgactgcactaggtccgacagccgt

SEQ ID NO: 39507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcgctgtcgtgatttctgaacgagggcc

SEQ ID NO: 39508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcggattataagttgatgtgagcctgaa

SEQ ID NO: 39509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcggcacgtggttagattgaacggacac

SEQ ID NO: 39510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcggggcgaacgcatatcttgcaagcac

SEQ ID NO: 39511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagcgtgccctacacggtttggagatgctg

SEQ ID NO: 39512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggaacaggcggtagagggcgcaccggtt

SEQ ID NO: 39513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggaatttcctctgcaagcgtacatcgtt

SEQ ID NO: 39514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggacagggagaatgtggagactccggcg

SEQ ID NO: 39515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggcagtcaccgctgatacgggtgtttcc

SEQ ID NO: 39516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggccttgttcaatcgagtctctcggctg

SEQ ID NO: 39517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagggacactatcaactctagcgctcgtct

SEQ ID NO: 39518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagggccaatgggtacttggttccgatgct

SEQ ID NO: 39519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagggctgccaccaagacgatgcatgtgcg

SEQ ID NO: 39520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagggggacatgctccctggttgtagtcgg

SEQ ID NO: 39521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagggtcaccgacgaaatcgtctacggtgc

SEQ ID NO: 39522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagggttgcacactgaaattcgggtgcctc

SEQ ID NO: 39523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggtagcgggggcagctttatcgttttcg

SEQ ID NO: 39524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gataggtggctaagcacgtgttaggaacaaga

SEQ ID NO: 39525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtaatacccgggaactcggctctctcgg

SEQ ID NO: 39526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtaccggtgataggccatgttgataagg

SEQ ID NO: 39527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtactacgtcggattgggacgtctgcgg

SEQ ID NO: 39528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtagcctggcgcaccgttttctattgtc

SEQ ID NO: 39529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtagttacaccgagaggagaccttgcgg

SEQ ID NO: 39530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtcaagcgtagatgcgtttggtgtgtat

SEQ ID NO: 39531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtcgcacgtacgcaacggcagggtagca

SEQ ID NO: 39532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtctgggagcggtgacggggattcacga

SEQ ID NO: 39533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagtgatacatgtctggagggttttgaaca

SEQ ID NO: 39534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatagttggcattacactccatacttctaggg

SEQ ID NO: 39535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatataaatggctgtcacgaccaagattacgg

SEQ ID NO: 39536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatataccgccataaccgttggattgtttagc

SEQ ID NO: 39537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatataccttgtaggctaagtgtcaagtaacc

SEQ ID NO: 39538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatagaaagctccaaggtcgtgtgtgtgcg

SEQ ID NO: 39539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatagacgttgaatttgtatggcgtttcat

SEQ ID NO: 39540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatagtacttattcggcggatgactgtaga

SEQ ID NO: 39541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatatcatcaggaccgcctgatctcgcgtc

SEQ ID NO: 39542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatatggggacttagggtttcgagtgggtt

SEQ ID NO: 39543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatattgttgccttgttagtattatacgac

SEQ ID NO: 39544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatcaatgagaacgatctatcaaacgtgac

SEQ ID NO: 39545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatcattccgagggcgtatttaggtgcata

SEQ ID NO: 39546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatccataactttactacatggaacgatgt

SEQ ID NO: 39547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatcgcaccgctttgaacggagaggttgtt

SEQ ID NO: 39548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatcgtcgcgttggccttcgactccgtgaa

SEQ ID NO: 39549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatctcttccacttgatccacgttcgtcac

SEQ ID NO: 39550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatcttcatgtattgcacggccccgatggg

SEQ ID NO: 39551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatctttggtggctgtcgctccatttcctg

SEQ ID NO: 39552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatgaccgctacgatctgcgagttgtgaca

SEQ ID NO: 39553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatgcccgggtgaggcagtcggaaggcgta

SEQ ID NO: 39554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatgccgaggattcatgtgcaggagagatg

SEQ ID NO: 39555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatgcggcacgcgaattgaagtagagtaca

SEQ ID NO: 39556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatggcaaggatcgtagctgtcggggccgt

SEQ ID NO: 39557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatgtattgtggccgacatgcaccgggacc

SEQ ID NO: 39558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatgtgtgagggcgcaattccagtgggtat

SEQ ID NO: 39559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatattacggcgacggtggcagctgcaattgc

SEQ ID NO: 39560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatattcaggccacggatccgcgcctcttggg

SEQ ID NO: 39561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatattccgttagtagtttttgtccggactat

SEQ ID NO: 39562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatattcctcggccttgctctgctaggggtgg

SEQ ID NO: 39563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatattgccggaacatgggtcattttgatcta

SEQ ID NO: 39564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatttgataaattaggcgctaatttgattt

SEQ ID NO: 39565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatttgcagattgcgttgaccatgagacct

SEQ ID NO: 39566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatatttgggcgtacgtgcttgctcattaccg

SEQ ID NO: 39567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaaacgagcgacattttacaggagttgtc

SEQ ID NO: 39568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaaacgtcgtttaaaacgcggcttcttcg

SEQ ID NO: 39569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaaagctcgcccgcatcacttacactcgg

SEQ ID NO: 39570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaaagggagccacacacggattggacttc

SEQ ID NO: 39571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaaaggtttacccaacgcagtaagcctaa

SEQ ID NO: 39572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaacaaacttcaccctgggcaagtagtgg

SEQ ID NO: 39573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaaccaagtgtatatgcgggagaggctgt

SEQ ID NO: 39574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaacgaaggaggttctccgaacgccggcg

SEQ ID NO: 39575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaacggggtaccgatcaaggaggcgcatc

SEQ ID NO: 39576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaagcctcgttggaccaaaagtaaattgt

SEQ ID NO: 39577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaagggtccgagttcgttctagtgcggga

SEQ ID NO: 39578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacactggcctgacgtgttacatcgcctc

SEQ ID NO: 39579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacaggtggggctcagttgcgcttcgtga

SEQ ID NO: 39580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacagttcaatacgggcctgggacagctg

SEQ ID NO: 39581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacccgcctgcgctaaacgtattctgact

SEQ ID NO: 39582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaccgacatactctgacgtttggcatagc

SEQ ID NO: 39583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaccgttggcggcgaggtcgttccacagg

SEQ ID NO: 39584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacctcacacttattggacacatgctccc

SEQ ID NO: 39585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgatgtaggtgtgacatttattctgtc

SEQ ID NO: 39586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgattctgggagccagatcgctgctac

SEQ ID NO: 39587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgccacgtagcaattgctgcgagggtt

SEQ ID NO: 39588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgccggggaggtagtaggatacatgtc

SEQ ID NO: 39589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgcgccgtgactttggattcgtgggtt

SEQ ID NO: 39590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgcgcctttcgatcaagtccggtcctc

SEQ ID NO: 39591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacggcccatatgctttgggatgcaaact

SEQ ID NO: 39592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgggctgaagcgatcatgtttatctat

SEQ ID NO: 39593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgggtgactctgggcagcagcggcttg

SEQ ID NO: 39594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacgtttgttgtgttagcgtcatgtcccc

SEQ ID NO: 39595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacttaagttcttatccattctgtgttca

SEQ ID NO: 39596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacttcctttaaactcgtgtctatataat

SEQ ID NO: 39597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacttgaggcggggctgtctaaaccggtt

SEQ ID NO: 39598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacttgctagcagtgcccttagaagcgag

SEQ ID NO: 39599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcacttgtttaggcttgggtcgttcgtggg

SEQ ID NO: 39600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcactttcaggctggcctctaaggtatttt

SEQ ID NO: 39601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagaacttttcgccacgatgttcctagtt

SEQ ID NO: 39602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagcacgtgttatacgggtatgagagagc

SEQ ID NO: 39603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagcggacgacaagggatggatccacgga

SEQ ID NO: 39604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagctcacgtatagtgcagtgaactccta

SEQ ID NO: 39605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagctgacggaggtgtcggcggtctgcac

SEQ ID NO: 39606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagctgagagtgtccgaccgcgtgctctc

SEQ ID NO: 39607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaggagcgtaagttatcggatatcgctgt

SEQ ID NO: 39608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaggatcgcccggtacctatgttcatatg

SEQ ID NO: 39609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaggatgaggttatatacccctttgtgcg

SEQ ID NO: 39610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaggccctaatccgtcccgttttgcggct

SEQ ID NO: 39611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaggctagaccaagggacgcatcatcctt

SEQ ID NO: 39612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcaggtaaaagcaaaaacgtacactaaccg

SEQ ID NO: 39613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagtagcaaggttaaggtcgacaaggact

SEQ ID NO: 39614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagtgggatataatcctcggcagtaattt

SEQ ID NO: 39615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcagttcgtgaccccttgtcttctgggatg

SEQ ID NO: 39616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatcaaggaacttttgacatgttctcgag

SEQ ID NO: 39617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatcaatagcatgtgcccacgcccgaaca

SEQ ID NO: 39618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatcgcgcgtatgatgtcccgcttcgtac

SEQ ID NO: 39619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatcgtggtcatttttatcgggagttatt

SEQ ID NO: 39620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatctgcactagcgttggggactcgccgg

SEQ ID NO: 39621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatgaaacaaccgttaagtagactatgcc

SEQ ID NO: 39622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatgaaggatttcagggagttaggtgctt

SEQ ID NO: 39623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatgcatgtcgcgttggtgctgcattggc

SEQ ID NO: 39624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatgccaactgtgtctcgttatgggcacc

SEQ ID NO: 39625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcatgtagtactccctacacaaagttatga

SEQ ID NO: 39626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcattcattgagcctgataacggacgcttg

SEQ ID NO: 39627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaaccgggctgacgacaaatgtggttag

SEQ ID NO: 39628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaacgagcactagggactagagtagccg

SEQ ID NO: 39629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaaggtctgcgggcgccgtcgactcacg

SEQ ID NO: 39630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaatccataggcgtatcctggttgcggt

SEQ ID NO: 39631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaatcctgaaccggttcaaactatcccg

SEQ ID NO: 39632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaccgtcggtggttcacatgtatggtcc

SEQ ID NO: 39633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccacgcaaaggggtcaacccgctctccgg

SEQ ID NO: 39634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccacggggtggcggtcggggtagttcaat

SEQ ID NO: 39635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccacggtatggaccatacgtttacttcgc

SEQ ID NO: 39636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccactcaggtgtcacatgggttgcctgct

SEQ ID NO: 39637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccagatgtgggggcatttctcctgtagag

SEQ ID NO: 39638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaggagagtcagcgggtgtgtattggcg

SEQ ID NO: 39639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccaggccgtcaaaccaacgggtgagtgtt

SEQ ID NO: 39640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccagtacatgatgagactagttgggcatg

SEQ ID NO: 39641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccatcattctagccccaaaggcagctgac

SEQ ID NO: 39642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccatccaaaggcaatctacacttgtcaca

SEQ ID NO: 39643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccattcaatgacgagtaattccaaactcc

SEQ ID NO: 39644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccattcagtaacggtctggctcatcaatc

SEQ ID NO: 39645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccattcgggatacacccgatactcgcgtt

SEQ ID NO: 39646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccattgatgttacacggatatgcagctcc

SEQ ID NO: 39647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccactgtaaggaggcgggaagcaggacg

SEQ ID NO: 39648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccagcggtgccagctacgacgcttcacg

SEQ ID NO: 39649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccgaaggggcttgcggaggaatgaagcc

SEQ ID NO: 39650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccgcagccggccctagcgagtgcaacgc

SEQ ID NO: 39651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccgctccacctccttgtcggttcggtta

SEQ ID NO: 39652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccggaccaatactctacattgtcagtcc

SEQ ID NO: 39653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccgttcggtagtcttagatataacaaga

SEQ ID NO: 39654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccctcgcgcgctggcacacgcacattggt

SEQ ID NO: 39655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccctcgtctagaaagtgattcgaccagtg

SEQ ID NO: 39656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccctggtttcaggcagtgttggaccacgc

SEQ ID NO: 39657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcccttggggacagccaacactacttcacg

SEQ ID NO: 39658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgaagcgacccgacaacttcccggccta

SEQ ID NO: 39659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgaatcgtatctcaggttataagtgtcc

SEQ ID NO: 39660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgacttggttgtgagaggttgctgatct

SEQ ID NO: 39661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgagtcgccggacatgatcgcatagttc

SEQ ID NO: 39662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgatagaaccttgtctcctatatagaat

SEQ ID NO: 39663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgatagacagttcatgtctcagtgccca

SEQ ID NO: 39664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgcaccagtgcacgcgtatctggcttat

SEQ ID NO: 39665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgcagtgcagctgactatttatctcaag

SEQ ID NO: 39666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgcggcctcggagttcaaaccgctgttc

SEQ ID NO: 39667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgctacaagggacgtcctgtacgcaacg

SEQ ID NO: 39668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccggaacatcgtcaggcttggagtcatcc

SEQ ID NO: 39669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccggcgtagactatggaggcggtagcaag

SEQ ID NO: 39670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgggtacgattggtgttggaggagcctg

SEQ ID NO: 39671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccggtatggcagaaacggcttcagccctc

SEQ ID NO: 39672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgtctctggtcctgctgtgcaagtgtcg

SEQ ID NO: 39673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgtgacaattattccaacccgctgctgg

SEQ ID NO: 39674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgtggctgccctacacgttagcggtccg

SEQ ID NO: 39675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgtggggaggacacctctatgaaccgta

SEQ ID NO: 39676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccgttgcaggagaaccggttcctgcctcg

SEQ ID NO: 39677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctacagaacagggttacttcatagcaat

SEQ ID NO: 39678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctagcgtgagacatcgattccacatgcg

SEQ ID NO: 39679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctattttgtattcggctagtatcagttg

SEQ ID NO: 39680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctcgctagattaagattagcctggggca

SEQ ID NO: 39681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctcgtaagccgtgaccttgtattttcgg

SEQ ID NO: 39682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctgaaatctgcactgttctgggtgtgcc

SEQ ID NO: 39683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctggactaactgtcgacgccagtgggcc

SEQ ID NO: 39684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctggttcagccaaacagctgactattcg

SEQ ID NO: 39685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctgtagagacgtagacccggcgatggtt

SEQ ID NO: 39686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccttacacgatgaagtataccattctact

SEQ ID NO: 39687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatccttcacggttgggctttactaggtgagt

SEQ ID NO: 39688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcctttcctcgtgttggaggtgacacgtac

SEQ ID NO: 39689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgaaggactaaacgtgatcttggaagcgg

SEQ ID NO: 39690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgacatacgatctgcaaagtctagcgaac

SEQ ID NO: 39691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgacgcgtgcggcgggtacacacctcgca

SEQ ID NO: 39692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgacggtctggcaaagtcggctgtcgtgt

SEQ ID NO: 39693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgactttaggttattttaacggtttttac

SEQ ID NO: 39694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgagaggggattgacgattctctctgggg

SEQ ID NO: 39695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgagcaaggagacgcggtaggatgtgtac

SEQ ID NO: 39696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgagcagcaacagccatcatcctgtctcg

SEQ ID NO: 39697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgaggcacacaggtcacaaccgtctggcc

SEQ ID NO: 39698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgaggttgtttatcaacggccccggtacc

SEQ ID NO: 39699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgaggtttggcacggcgcagattgctctc

SEQ ID NO: 39700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgagtcaggcggagggatgtctcttccgt

SEQ ID NO: 39701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgagtcttgcaggattacagtcatgtgta

SEQ ID NO: 39702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgagtgcgtatactgctaccccactcgca

SEQ ID NO: 39703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgatcgaaactctttatcgtcggcactag

SEQ ID NO: 39704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgatgcggagcggtttgttctcgtctgac

SEQ ID NO: 39705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgatgtgagtgaatgaagatacactgttc

SEQ ID NO: 39706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcaaccagcagctcccagtcacggcgac

SEQ ID NO: 39707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcaatttgtcgtctaatcgcgtcatcgg

SEQ ID NO: 39708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcaggggggtggggccaacccgcgcgga

SEQ ID NO: 39709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcatagaagcgttatctccttggatcgg

SEQ ID NO: 39710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcattttcgcttgcgtccaatggagttt

SEQ ID NO: 39711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcccaccctggacatggattgggagggt

SEQ ID NO: 39712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcgccccattcctaatttcatttacgga

SEQ ID NO: 39713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcggaaccctgcatacattactcaggat

SEQ ID NO: 39714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcggtactcaagaggagtctttgtgtca

SEQ ID NO: 39715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcgtatttgtgataggttcactgacccg

SEQ ID NO: 39716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcgtcctgtaggtggtcctcaggtctgg

SEQ ID NO: 39717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcgtgcataggaagaggacgagcttgct

SEQ ID NO: 39718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgcgtgggtcagggtttccacgtcgcggt

SEQ ID NO: 39719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgctcatgttttctgcatacctgctgttc

SEQ ID NO: 39720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgctcgaaccttacccttgctttatagca

SEQ ID NO: 39721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgctctactggtctggtcctcatgctcgc

SEQ ID NO: 39722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggaccggctgggttaacgatgcccctct

SEQ ID NO: 39723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggacgtgcgaacgtttatgacgcctgcg

SEQ ID NO: 39724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggccaaagcgcagcgtatttccagttcg

SEQ ID NO: 39725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggccagcggggcgtgaggtgcatcgagt

SEQ ID NO: 39726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggccatcttcttgcgtgggtccagccgg

SEQ ID NO: 39727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggcccttacttgatcagcatgctctagg

SEQ ID NO: 39728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggccggagcacacttacacatcgcactc

SEQ ID NO: 39729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggcgacgtgggctgcaaagcgggtaggg

SEQ ID NO: 39730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggcgttgcggccgtagttctgcagcttg

SEQ ID NO: 39731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggctaaagcagacctcagtttcggcctc

SEQ ID NO: 39732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggatcagttcctaattttcaacgcggt

SEQ ID NO: 39733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggatctgccggcacctcacgttggctg

SEQ ID NO: 39734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggattggatatcgtgcccgctctggtg

SEQ ID NO: 39735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggcggtggggggacatcaatacaggcg

SEQ ID NO: 39736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggctagggcaggaggtgatggtgtcct

SEQ ID NO: 39737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggggcttcagttatgatatgtacgacg

SEQ ID NO: 39738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggggttgaggaaggcttatcggggctgg

SEQ ID NO: 39739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggtactgtacggtgatctgagtgtcta

SEQ ID NO: 39740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgggtttactcggataatattgccagtca

SEQ ID NO: 39741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggtacggcttctcttgtcagataggggg

SEQ ID NO: 39742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggtacgtttggacgtctttacgctgctc

SEQ ID NO: 39743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggtagaaagctggtatctgacgcttccg

SEQ ID NO: 39744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggtggaaaggacggcaatgtttcttagc

SEQ ID NO: 39745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggtgtcggccggcgaatttggtgtagcg

SEQ ID NO: 39746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggttacctgtcagggccctaccttcgag

SEQ ID NO: 39747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggttaggaacacacaaggatccgcgaac

SEQ ID NO: 39748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggttgaagacatcacgaccggatatgcg

SEQ ID NO: 39749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcggttgccgagtcgtttgcctacttttta

SEQ ID NO: 39750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgtaggaggccttgtaggatccctccgta

SEQ ID NO: 39751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgtatcaataaccaaaacctcgtgcaaag

SEQ ID NO: 39752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgtgccccagaggacattcgtgctatttg

SEQ ID NO: 39753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgtggttagccaatgttctcggagcttct

SEQ ID NO: 39754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgtgttgtctcaccctacggaattcgtcg

SEQ ID NO: 39755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgttagtgttccccggttgaggacgtctg

SEQ ID NO: 39756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgttcatgtgcataatagacgtttggctg

SEQ ID NO: 39757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcgtttcgtctagcacctaaggctctagtt

SEQ ID NO: 39758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctaacgccggaccagattgcgcttggtgt

SEQ ID NO: 39759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctaacttagcttgcatgtaagccacagtc

SEQ ID NO: 39760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctaacttcggcgtgttcgttccctcaggc

SEQ ID NO: 39761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctaatagtgcattccgtccctcacagagc

SEQ ID NO: 39762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctacatggtcagtgacataagtccggcgg

SEQ ID NO: 39763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctaccgcgctttgcttagtgtgtgatggc

SEQ ID NO: 39764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctacgcatccacaacggaataacgctacc

SEQ ID NO: 39765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctagacgacggttgatgaggtctgctagg

SEQ ID NO: 39766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctagcgggtctctttctccctcgccgagc

SEQ ID NO: 39767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctagtcaacacaactcgcacgcgccggcg

SEQ ID NO: 39768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctagtgggagtgacgaactggtccgacat

SEQ ID NO: 39769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctatgctctcgtgtagtaccgggcctctt

SEQ ID NO: 39770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctattgcgcttgtttttaacagtcctcca

SEQ ID NO: 39771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcagcacactgtcggagcaggccggagg

SEQ ID NO: 39772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcaggacgccgtaacgggtgtgcgccgc

SEQ ID NO: 39773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcaggttctcatcagtggctagctgcaa

SEQ ID NO: 39774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcatcagcgcggtgtcttattgtcccaa

SEQ ID NO: 39775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctccatctcccgtcacggcgcttgtgtgt

SEQ ID NO: 39776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctccatctgcctgcgaaacaactatggcg

SEQ ID NO: 39777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcctctagcgtggggggcgccgaatgtt

SEQ ID NO: 39778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcctgatcgagaacgatcgttttgacag

SEQ ID NO: 39779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgaatttctggcgtttctggtgatctg

SEQ ID NO: 39780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgctctcgtctcatcaacgctgcccgt

SEQ ID NO: 39781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgggagctgtgaccggtggaggagggg

SEQ ID NO: 39782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgtaacttcgattcgttcgggccttat

SEQ ID NO: 39783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgtactagcctatcaccatattgtgtt

SEQ ID NO: 39784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgtcttgggtctcatctgtgcagcact

SEQ ID NO: 39785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgtgggtgcctaggttctgtagcatgt

SEQ ID NO: 39786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctcgttgtttgtcctctatttggcgggca

SEQ ID NO: 39787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctctcgacgaaagttgggattgcatgtac

SEQ ID NO: 39788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctctcttgatttcggcagcttgtgaccgg

SEQ ID NO: 39789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctctggtgcctgacattggtgtgagtgag

SEQ ID NO: 39790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgagaaatggcccgtgacgaaggttgac

SEQ ID NO: 39791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgaggtaaagagatatgatttgctactc

SEQ ID NO: 39792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgatggcagctgggagcttgttagggga

SEQ ID NO: 39793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgcggcgtttcgatgcattagcctcgcc

SEQ ID NO: 39794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgctctttgtactgggataccttagccg

SEQ ID NO: 39795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctggtacaaagaccactgccaacatcgtg

SEQ ID NO: 39796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgtactccgactctaaatacttttgacg

SEQ ID NO: 39797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctgtgggttaggcggatctctagcccttt

SEQ ID NO: 39798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttagggtaaagacatcgcttgtagcaag

SEQ ID NO: 39799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttatttaatgtagcccaatggcaagtgc

SEQ ID NO: 39800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttcaggcttgacggcacgttcttacggg

SEQ ID NO: 39801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttcgggtccttgttgtacttaggcggga

SEQ ID NO: 39802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttcgtcctcggtgggcgtatggctcctg

SEQ ID NO: 39803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttcttcagtttttgtaagagtgacccaa

SEQ ID NO: 39804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttgccgtgagaccggaacatctgcgcac

SEQ ID NO: 39805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttggtgtatttaagcttggtgcattatt

SEQ ID NO: 39806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttgtaattccatcactgcacttggtggc

SEQ ID NO: 39807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctttcaccttggggctacttggcgagtgg

SEQ ID NO: 39808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctttcctggaacgcgaagtagatggattg

SEQ ID NO: 39809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatctttcgggtagggcggtaacgaagcaaaa

SEQ ID NO: 39810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatcttttactgtccgtctatgactggtgtaa

SEQ ID NO: 39811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaacggtcacgggtgcactctgggagta

SEQ ID NO: 39812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaagacattcgcgacacaaatgctattc

SEQ ID NO: 39813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaagagattagctagtcaaacccgcggg

SEQ ID NO: 39814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaagctgattcgtctaccgtattaccgc

SEQ ID NO: 39815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaatgctgtacgggtgggcgagtgttcg

SEQ ID NO: 39816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaacaggaccaaatggcacctcggagcat

SEQ ID NO: 39817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaacaggcaacacgatgacaattagtgcg

SEQ ID NO: 39818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaactcgccttactcagtgcagtcaccgc

SEQ ID NO: 39819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaactttgtgacggggtgaataggtcaat

SEQ ID NO: 39820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaggatggtacaagtgcctagtccgcga

SEQ ID NO: 39821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaaggcggtgtattcgaggtggtacgtgt

SEQ ID NO: 39822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaagtagcgaccacgggttgcaaattatg

SEQ ID NO: 39823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaatcggggctcgtaacttaggctcgtcg

SEQ ID NO: 39824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaatctttgtgtcgtctgccagtgtgggg

SEQ ID NO: 39825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaatgcggaggacgttgaggtcctgttgt

SEQ ID NO: 39826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacaactgccgtgcgagtatacctgttag

SEQ ID NO: 39827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacaagggcgtaggagaagggggcctcgc

SEQ ID NO: 39828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacacacttcggctcagttacgcgccggg

SEQ ID NO: 39829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacacactttcgcaaagggcgagtttttc

SEQ ID NO: 39830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacagactggatttcggccgccctcctca

SEQ ID NO: 39831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacccaggggcaggtaatcgtcatacatc

SEQ ID NO: 39832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacccgggctgaatcaaggcgcatttagt

SEQ ID NO: 39833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaccggcgtagggcgcgctttggttgggg

SEQ ID NO: 39834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaccggggggcgcaacttgagccttgcgg

SEQ ID NO: 39835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacgaggctttgcgaaggaagagcaggtt

SEQ ID NO: 39836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacggaggcaagggggacttggcgcgact

SEQ ID NO: 39837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacgggtgtggttggccggtcgagcgctg

SEQ ID NO: 39838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacggtaatggctagatgaagcaaaacca

SEQ ID NO: 39839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacggtagtcacgtccgtaacaccgctgt

SEQ ID NO: 39840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacgtgacgctgtgagggattgttccagc

SEQ ID NO: 39841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgactacaaggattggatcgggtgtagtgt

SEQ ID NO: 39842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgactggcgacccttggaaaacttggatat

SEQ ID NO: 39843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgactttactataatgaccagagattcacc

SEQ ID NO: 39844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgacttttctgaatggctgcattacctcgg

SEQ ID NO: 39845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagaaaatgctcggctttcacgttggggc

SEQ ID NO: 39846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagagggagttctggcagtttctgagggg

SEQ ID NO: 39847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagcgcaacagtagaacgtgttactgatg

SEQ ID NO: 39848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagcgtacgccagctccaaccctcgctac

SEQ ID NO: 39849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagcgtcaatcgttatgtgtggccgggga

SEQ ID NO: 39850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagcgtgggcctttacggttgacttggcg

SEQ ID NO: 39851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagctactttgaagggtcggggcgcacca

SEQ ID NO: 39852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaggacaactctaaggctgtcagtggggt

SEQ ID NO: 39853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgaggtacgatgtgtatcgcgacatcacgg

SEQ ID NO: 39854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagtaaattgttatgttgattgttcagat

SEQ ID NO: 39855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagtccaggcaaagtacgtatgcccattg

SEQ ID NO: 39856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagtggtaggggttggggagttagtcacg

SEQ ID NO: 39857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgagttcgggcgctggagtgatctgtggat

SEQ ID NO: 39858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgatagtgggttctgggttcacgggtagaa

SEQ ID NO: 39859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgatatattaagctctctggaaagtttacg

SEQ ID NO: 39860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgatcaagcccagttggtgcctggtatgta

SEQ ID NO: 39861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgatgacgagggatatgtgcggccgtacgc

SEQ ID NO: 39862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgattgcggcgctacggcccgtcttggtgc

SEQ ID NO: 39863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgatttacaaagctttttgtctgttgttgg

SEQ ID NO: 39864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaaccttaatatgctcacattcagtttc

SEQ ID NO: 39865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaactggaccacgacctgacgcgttgcc

SEQ ID NO: 39866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaagaaaaagtagatcggatccctgatc

SEQ ID NO: 39867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcacaagacgtttgttcctgttttctggg

SEQ ID NO: 39868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaccgccgcaacatggagttcttcgccc

SEQ ID NO: 39869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcacgagcatggggtgcccatgcggtggc

SEQ ID NO: 39870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcacgcacatatcgtcattgctccatcat

SEQ ID NO: 39871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcactccatgtaagccggcgacgggactc

SEQ ID NO: 39872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcactgcggtgtactgcgttcctgctgtc

SEQ ID NO: 39873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcactggatcgcttgttcatatgctctca

SEQ ID NO: 39874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcactggggcctgctcagacgtgctgtgg

SEQ ID NO: 39875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcactttggttaactggtcttaggcaagc

SEQ ID NO: 39876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcagcatgcgtcacgcgagtttatgactc

SEQ ID NO: 39877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcagcgtcgtttactgggtttatcggagt

SEQ ID NO: 39878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaggaactaggacgctcgtgagcctgcg

SEQ ID NO: 39879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaggcccacgagaccgtcccgatacaga

SEQ ID NO: 39880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcagggcgggccgcgcttctttgactgtt

SEQ ID NO: 39881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcaggtaccgtcgactccccaagcggacg

SEQ ID NO: 39882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcatcttcaggtacatgcttgcgcgttta

SEQ ID NO: 39883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcatgatattcgccatcgggtttactgga

SEQ ID NO: 39884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccaggccaccgtttcgttcaccgggcgc

SEQ ID NO: 39885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccaggttcaccaggggaaggtccagata

SEQ ID NO: 39886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcccaaggataccttcatgacagtcgtca

SEQ ID NO: 39887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcccacgctggttcgtcattttgctccac

SEQ ID NO: 39888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcccatacggtgtcagttcaggtcgggcc

SEQ ID NO: 39889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcccattgacggttgagcggtagtttgtg

SEQ ID NO: 39890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccccaggtaaccgacacgtatgcctaga

SEQ ID NO: 39891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcccggagacaaacgtcaattgacactgg

SEQ ID NO: 39892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcccgtccattacgaatctgtcgtgacgt

SEQ ID NO: 39893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccctatttacgcttcactcattcattac

SEQ ID NO: 39894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccctggctttggagtacaacactaggtg

SEQ ID NO: 39895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccgacatgtgttttgtcctcgctggcca

SEQ ID NO: 39896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccggtcattcaatgttgggtacattcac

SEQ ID NO: 39897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgccggtgatgagcgacgactgcctctctt

SEQ ID NO: 39898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcctaggaggatgtgctgccccttcatgc

SEQ ID NO: 39899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcctagttaatggaccgcgctctgaccgt

SEQ ID NO: 39900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcctctggtgggggggtaactgcgcctcg

SEQ ID NO: 39901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcctgggtgtcgcacaatcttccaaaagt

SEQ ID NO: 39902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcctttattgtcttgcgccgtctcggtgt

SEQ ID NO: 39903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgaaaggaaagattccttcggtgcaacc

SEQ ID NO: 39904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgagcatggcccgtacgcgtagtggtct

SEQ ID NO: 39905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgagcttgaagtcactgcccgcgcactg

SEQ ID NO: 39906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgaggcacgatgcaaattgcaaaccctc

SEQ ID NO: 39907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgataaggactccaagatttttgggtga

SEQ ID NO: 39908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgatgggcctttgtgctttataacccct

SEQ ID NO: 39909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgcagggtatctgagggtctgtgcggta

SEQ ID NO: 39910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgcgtcatcatgtactggtactttgttt

SEQ ID NO: 39911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcggcggtgcgatgggccagtgtttatta

SEQ ID NO: 39912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcggctctgtgcaatatccggtgcatgtt

SEQ ID NO: 39913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgggccgcatgtagaaaccagccacggg

SEQ ID NO: 39914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcggtgtggctgttgtgctccttgttccc

SEQ ID NO: 39915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcggttcgcagtatggtgttgtgttacaa

SEQ ID NO: 39916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgtacgcgttcctccgctcaagttacct

SEQ ID NO: 39917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgtaggcgaccaccgtttcgttgtgcac

SEQ ID NO: 39918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgtccatctcatgaagatcaggctatac

SEQ ID NO: 39919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgtgtatccccattctgggctggtctcc

SEQ ID NO: 39920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgttaaagttgctgtgtccgacgcgcta

SEQ ID NO: 39921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcgttggggttgggctagccggataaggg

SEQ ID NO: 39922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctacggtcgtgactgtctcgccggtacg

SEQ ID NO: 39923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctacttcgaactctcctgctgctcctag

SEQ ID NO: 39924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctatacggctgatgactgtttgagcgtg

SEQ ID NO: 39925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctcatcagtaccctctaacgatcttgtg

SEQ ID NO: 39926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctccaccgatacctcgccggtcagccgt

SEQ ID NO: 39927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctccggagtagttttgtaacgccccatg

SEQ ID NO: 39928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctcgcctggtctacaaatggagctttgg

SEQ ID NO: 39929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctcgcttgcctgtccgccctggtatgaa

SEQ ID NO: 39930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctctccgggcacgactctaacgttgtcc

SEQ ID NO: 39931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctgaaagggatgcgtggtcggctacgtg

SEQ ID NO: 39932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctgaatgtcaatactgtcttgtgctcga

SEQ ID NO: 39933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctgactcgtccgctactgacactggctg

SEQ ID NO: 39934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctgccgagttgtagtacagccttcaagg

SEQ ID NO: 39935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctgccggcttctgaacgtgctcaaggcg

SEQ ID NO: 39936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctggcgtgcctaaattcctgctttgtct

SEQ ID NO: 39937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctggggcgtgctcccactaaattctagt

SEQ ID NO: 39938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgctgtcattaaatgtccgtattttcggct

SEQ ID NO: 39939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcttcaccgggattgattcagctccagcg

SEQ ID NO: 39940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcttccatactttaccccagctagggaga

SEQ ID NO: 39941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcttctcctcacatcgccctggtctttcg

SEQ ID NO: 39942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgcttgagctcacgcttctaagtgcgcggc

SEQ ID NO: 39943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaaacggtatatctagtgagccgtcgcg

SEQ ID NO: 39944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaaccgggcctaccaaaattaatcagca

SEQ ID NO: 39945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaacgttaaccggtgtccggcgttgtgt

SEQ ID NO: 39946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaagcatccacggtaagaagtgtgctgg

SEQ ID NO: 39947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaagccggcgtgtgtttcatcctacttt

SEQ ID NO: 39948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaagggctggagtcccgggaacttgttg

SEQ ID NO: 39949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaatgtgtgggtgactatgcgtcagtac

SEQ ID NO: 39950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggacacgtagtttcctcttacgccatggg

SEQ ID NO: 39951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggacagcggtaaagcagaatcgctaaccg

SEQ ID NO: 39952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggaccatcagtttgcccgtatgaactatg

SEQ ID NO: 39953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggacgtcaacgctcaatattgcacgcgac

SEQ ID NO: 39954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggactcgttgtagtgttcacacttcggtg

SEQ ID NO: 39955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagagctactttctctcgagcttatgtc

SEQ ID NO: 39956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagagttgccaaagtcgtgtaccgcggt

SEQ ID NO: 39957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagcccccgttttgctttggaagggaag

SEQ ID NO: 39958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagcgttcggaggtgtgggatcagtttc

SEQ ID NO: 39959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagtaagttcaacgtagggcacggtgtg

SEQ ID NO: 39960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagtcagccaggttcctccagagtaggg

SEQ ID NO: 39961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggagtgagggacgcgtgttgggtcgaatg

SEQ ID NO: 39962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggatacgtatagtcttgtgccgggcctgg

SEQ ID NO: 39963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggatcaactacagtacttcccccatacgg

SEQ ID NO: 39964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggatgtagtgatccaaggctgaacactag

SEQ ID NO: 39965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggatgtttccgacgcttagggatcttcgc

SEQ ID NO: 39966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcaaagtcatccttctactgcctattcg

SEQ ID NO: 39967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcaagcgtgatcttggcaacatgtgcct

SEQ ID NO: 39968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcaaggagtcaaacgtagttccgccctg

SEQ ID NO: 39969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcaatacacggatgcccgcggaatattt

SEQ ID NO: 39970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcaccagaaaaggcctttggagagttag

SEQ ID NO: 39971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcatcctacaagccgctggggtcgtttg

SEQ ID NO: 39972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggccacctacgcacagtcaacgcacttaa

SEQ ID NO: 39973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcccattccggatcgcgcaacgcaatca

SEQ ID NO: 39974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcccgacgatgtaactcacagtggcgtg

SEQ ID NO: 39975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcctcatagtcttcttcttgttctatac

SEQ ID NO: 39976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcctggactaccaggaaggtatgcgtca

SEQ ID NO: 39977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcctttattgtgggtcaaattcctagag

SEQ ID NO: 39978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgacaatttttggaccgtggggaatag

SEQ ID NO: 39979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgactatggttgctcttacggcctggg

SEQ ID NO: 39980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgagctatcccatggcatcagcaatag

SEQ ID NO: 39981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgcaaccttttatcgtttctaggcctg

SEQ ID NO: 39982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgctggcagaggacgttccaggaatgg

SEQ ID NO: 39983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgggatcagtgcaatcatacgcttaca

SEQ ID NO: 39984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcggggtagccaggacacagggtctcgg

SEQ ID NO: 39985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgggtcaaggcggataccattcttttg

SEQ ID NO: 39986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcggtgccgagttgcgagggcttcgtct

SEQ ID NO: 39987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcgttactttgctcgtgcacttcgttca

SEQ ID NO: 39988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggctatgcgtagtggttttcctgtgcgtg

SEQ ID NO: 39989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggctcacattcacacctccggaatactca

SEQ ID NO: 39990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggctcataaatgatattatcctgcgctcc

SEQ ID NO: 39991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggctgaatgatcagggtgtcgtctttaaa

SEQ ID NO: 39992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggctggattccgacgctttctggccaatc

SEQ ID NO: 39993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggctgtagtcgacgtagtttgtgtgttac

SEQ ID NO: 39994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggcttgttacccctgtctatagggttacg

SEQ ID NO: 39995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggaccggacgccagtctcccgagtgatt

SEQ ID NO: 39996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggactgccttctagatcagctcagggtg

SEQ ID NO: 39997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggagaggggcctcccaaccggttagtaa

SEQ ID NO: 39998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggcaacttgccatcgatatccggattgc

SEQ ID NO: 39999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggcaaggtctcctctctacgttgcatat

SEQ ID NO: 40000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggccatattttgttgaatagtattggtg

SEQ ID NO: 40001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggcccaaggaatggtaggatgcgcggga

SEQ ID NO: 40002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggcgcaggagggggcagagcttcaccta

SEQ ID NO: 40003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggctacggttaggctgcctggggctcgc

SEQ ID NO: 40004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggctggcgatgcaagtcctgagctcccg

SEQ ID NO: 40005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggggacatgaccgggtgattgtattggcg

SEQ ID NO: 40006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggggacggcatgcattttcgcgagttccc

SEQ ID NO: 40007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggggctggtgatttcgtttgtgcacgcca

SEQ ID NO: 40008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggggacatcaccgggaagaccgtcgtgt

SEQ ID NO: 40009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggggtttcacaaggggatatctcgcttg

SEQ ID NO: 40010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggggtaggggtgcgtaagttggcatgcgt

SEQ ID NO: 40011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggggtctggctacgcatcgggggcggtgg

SEQ ID NO: 40012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggtcagccatcgagtcttctaggctcct

SEQ ID NO: 40013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgggtgtccgattgttcaattggttcactg

SEQ ID NO: 40014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtacgatggtgtctcgtaggttgagggc

SEQ ID NO: 40015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtaggacgatgggattgaacgccaccta

SEQ ID NO: 40016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtatcgttacccgcttcaccctccatgt

SEQ ID NO: 40017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtccctaggacgtgcttgcacctcgagt

SEQ ID NO: 40018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtccttacgttatcgactattttcaagc

SEQ ID NO: 40019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtcgaacgcgtcctgctgccgctcagta

SEQ ID NO: 40020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtcgcgtaacagatcggccagctcaagg

SEQ ID NO: 40021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtcggacgaagatacggcgactggttta

SEQ ID NO: 40022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtctaggggaatgtgtctgtatgtaaac

SEQ ID NO: 40023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtgacatgccagttagttaaccccttgg

SEQ ID NO: 40024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtgactgtttggattatggggtacaaac

SEQ ID NO: 40025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtgatcacgatggcgccgtatactagag

SEQ ID NO: 40026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtgtagttttttcctaggtggctgggtg

SEQ ID NO: 40027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtgtatgtgaaccgtcttgcatggggtt

SEQ ID NO: 40028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggttacctcgcttcatgttaggccgcctg

SEQ ID NO: 40029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggttaggttagaacgagaggcgcaagatg

SEQ ID NO: 40030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggttagtacattgtgggctacgcccgtag

SEQ ID NO: 40031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggttcgtagatcctgcatccttcaggtgg

SEQ ID NO: 40032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggttggcgggggtttgttgctatgtgcga

SEQ ID NO: 40033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggtttcgttggtggttgatgcaggggtgg

SEQ ID NO: 40034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatggttttttgaataaacatacatcattgaa

SEQ ID NO: 40035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtaaacgaaacggctcctacggatactac

SEQ ID NO: 40036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtaagccgcgactaatgcgttttccttga

SEQ ID NO: 40037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtaagtaatgcctttgcataccttggagc

SEQ ID NO: 40038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtacaaccgagcggacaatgcgcccattt

SEQ ID NO: 40039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtacctacgagggtcctctctagggcatt

SEQ ID NO: 40040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtactatttccgcaaatatacgcttagtt

SEQ ID NO: 40041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtagaggatcttatttcatcttgtcccgt

SEQ ID NO: 40042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtagattgggtgctcaataggtgggagcg

SEQ ID NO: 40043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtagcccgaattcaagtgctcaccgcctg

SEQ ID NO: 40044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtagccggccgtgcagagtgaccaaacga

SEQ ID NO: 40045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtagctcttaggccggattactccttaag

SEQ ID NO: 40046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtaggtcaagaggcgtttcaggggcgtgc

SEQ ID NO: 40047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtaggtgactagctagtaggtatgcatca

SEQ ID NO: 40048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtatcatatagcgttaatggtaagctaat

SEQ ID NO: 40049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtatcgagttgagttaagcataggaactt

SEQ ID NO: 40050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtatcgtgcggggcagctgctatggtacg

SEQ ID NO: 40051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtatctgtgacggggggtttcggccggtg

SEQ ID NO: 40052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtatgccttccggatagagaacatttaac

SEQ ID NO: 40053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtatgggatactctgtgctgctcgaccat

SEQ ID NO: 40054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtcacgagcaccggtgttctaaatctgct

SEQ ID NO: 40055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtccacggaccaattatgatgcgctttta

SEQ ID NO: 40056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtcccgcaacaaaaggtcgctggccgagg

SEQ ID NO: 40057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtccgcaactgctcgatccgtggtgcata

SEQ ID NO: 40058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtcgggggtatgacagcctcgggtaaagt

SEQ ID NO: 40059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtctagaaaggcgcttttggtaaggatct

SEQ ID NO: 40060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtctattttcttgacgtccttttcatttc

SEQ ID NO: 40061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtctggtcattcctgcgaataacggtgat

SEQ ID NO: 40062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgaagattcactgttgtgtgtcagagga

SEQ ID NO: 40063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgaagtggcaggatctcaccggttccga

SEQ ID NO: 40064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgagaacacgcgggcacggttggcggtg

SEQ ID NO: 40065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgaggaacgcaccacttcactatgaccc

SEQ ID NO: 40066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgcacacgcgagaccggtttaacctcac

SEQ ID NO: 40067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgcatagcatacttcggggcaggaccta

SEQ ID NO: 40068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgccacgctgacaacaaatttcctgccg

SEQ ID NO: 40069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgccgtgtgattgtcgatcgagcaggat

SEQ ID NO: 40070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgcgcacaacgcgtcgcttggcttgtct

SEQ ID NO: 40071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgcgtccggcagtacttcgtcagtgtca

SEQ ID NO: 40072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtggaagccgacgcctgaacgtacgagag

SEQ ID NO: 40073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtggcatttgcgtatcttatctgtctgga

SEQ ID NO: 40074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtggtatgacggtcagacgcactcagttt

SEQ ID NO: 40075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtggtggcggtttgggggaagcgatcagg

SEQ ID NO: 40076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgtcatctcccgtgttaagcgcaaatac

SEQ ID NO: 40077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgtccatacgtcgtaaggagcccggctc

SEQ ID NO: 40078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtgttgcccgtctcgttccgatgcgcatg

SEQ ID NO: 40079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttaaggcattcttggcttccggtcgaga

SEQ ID NO: 40080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttacactctttttcatacctacgagagc

SEQ ID NO: 40081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttacgcaggtacagggttgtgactataa

SEQ ID NO: 40082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttacgtaaaagcccccgtttttgttcac

SEQ ID NO: 40083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttactgctaaacctccgggtctacgtgt

SEQ ID NO: 40084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttattgtttccgatgtattagggggtac

SEQ ID NO: 40085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttatttccgcgcccatagccaggactgc

SEQ ID NO: 40086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttcctcgcccggagaatcgcgtcttagg

SEQ ID NO: 40087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttcgcctcaaaagagacggttcgggatg

SEQ ID NO: 40088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttcggaagttaggatcaccagaatatgt

SEQ ID NO: 40089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttgaggcgtcaaacgaagcttaggcccg

SEQ ID NO: 40090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttggttgggcgaaacatccgcgcaggcc

SEQ ID NO: 40091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgttgtgtagtgcggtgggttcttgactat

SEQ ID NO: 40092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtttacactcgaacggtcgctcatcggtg

SEQ ID NO: 40093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtttcagcaacctggagactatcagatgg

SEQ ID NO: 40094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtttgggagctgtacgagcctgcacggat

SEQ ID NO: 40095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatgtttttggtaaggttcgacatgtggcatc

SEQ ID NO: 40096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaaacctttaaatattagctacatctgca

SEQ ID NO: 40097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaaatacccgcaccgtcatgtccgacgcg

SEQ ID NO: 40098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaaattacggggttcctatgttcgggact

SEQ ID NO: 40099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaacaactgcgggcaaccatgacaaatac

SEQ ID NO: 40100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaaccgataacgttggtggcatggtgtat

SEQ ID NO: 40101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaacttgccgtggctcgtttttaatacgc

SEQ ID NO: 40102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaagccgttctttcgcacatggaatatgt

SEQ ID NO: 40103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaaggtttccatggaagatggtttgggcg

SEQ ID NO: 40104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaatgtggaggtccgtagaacgcagggtg

SEQ ID NO: 40105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattacaaggcaatggcgggaatatggactga

SEQ ID NO: 40106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattacactctgcctggataaactaacctcga

SEQ ID NO: 40107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattacagctccatgttgactcttcctattcg

SEQ ID NO: 40108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattacatatgcagaagtacagctaatggatt

SEQ ID NO: 40109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaccgtaacacatactaaggggggatatt

SEQ ID NO: 40110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattacctcgtcgtgaagcttctagggtgtat

SEQ ID NO: 40111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattacgggatagcctgcttcgaccacgatcc

SEQ ID NO: 40112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattactaggcgtctacaggccctcacgccgg

SEQ ID NO: 40113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattactcgatagacagtttttggatacggtc

SEQ ID NO: 40114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagaaaacagccggtgcgatgacttactg

SEQ ID NO: 40115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagaaagttgagcgtcatagagggttcgc

SEQ ID NO: 40116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagaagcatcatgcgcgactgcttagtga

SEQ ID NO: 40117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagaataaaggcgtgttgatccaagcgcg

SEQ ID NO: 40118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagaatgttaagaattgtatgtaggatcg

SEQ ID NO: 40119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagatggcccagcgagctatcaagtgttt

SEQ ID NO: 40120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagcatgcaatacggatggcggacgttag

SEQ ID NO: 40121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagccctgtccggttcggttcattcctag

SEQ ID NO: 40122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagcgttgcaggcctacaggggcatggcg

SEQ ID NO: 40123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagctcagatctgcgacgacaccacgtac

SEQ ID NO: 40124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaggatggttcttcagcttcacatagtaa

SEQ ID NO: 40125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaggccaattcaggggtgccttcgcgtct

SEQ ID NO: 40126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaggcggagggcactttatcgggtgcggt

SEQ ID NO: 40127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagggctgacatcccgagctacgcagctg

SEQ ID NO: 40128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaggtccacgctggtgaacgaggaccgcg

SEQ ID NO: 40129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaggtcttttacctttgcggactaggcgt

SEQ ID NO: 40130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattaggtgacggtgcctcgaatggtgatgct

SEQ ID NO: 40131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagtacccaacacgtggctgggctatagt

SEQ ID NO: 40132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagtcatacctgcaaatcaggctgatttc

SEQ ID NO: 40133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagtctgcacctacgcggttgttcggtac

SEQ ID NO: 40134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagtgcgcatcctcatcacagccccggtt

SEQ ID NO: 40135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattagttgtctccgtcacaaatctattggga

SEQ ID NO: 40136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatatcgtccgaaggatttgctcgatatg

SEQ ID NO: 40137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatccggccaagctttagtgcctgtggac

SEQ ID NO: 40138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatcgagcggggctattacattttcgggt

SEQ ID NO: 40139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatcgtttttcactccataagaataagat

SEQ ID NO: 40140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatggcacctcagccttggcctagacgat

SEQ ID NO: 40141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatggtcagcgtcagggctcggcatgtat

SEQ ID NO: 40142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattatgtctctcagccccactagtttatatc

SEQ ID NO: 40143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattattcacgtgcagtattcatgtcttgggt

SEQ ID NO: 40144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattattcctccgagggactagtacatgttcg

SEQ ID NO: 40145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattattcggaccactagcgtaggatacatca

SEQ ID NO: 40146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattattggacgctggccttgtctcggtgcct

SEQ ID NO: 40147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattattgtttcggcactgtccacaggttggc

SEQ ID NO: 40148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcaacactttttccgcggagtgggggtaa

SEQ ID NO: 40149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcaatgatgcgttcctttatctggcggga

SEQ ID NO: 40150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcacacataatgcgcaacttatgactcgc

SEQ ID NO: 40151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcaccacgcgggaggccaaccgtggcggc

SEQ ID NO: 40152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcaccagcatcggtagatatattgctcgg

SEQ ID NO: 40153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcacgatcttcaccgcggcgatatgtgtt

SEQ ID NO: 40154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcacgtatacacgtctaagccgccttgaa

SEQ ID NO: 40155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcataaagcaagctgctaggcatattgag

SEQ ID NO: 40156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcatacgtcgtctctcggtcacatttaag

SEQ ID NO: 40157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcatcagctgggggacaggcagtgctttc

SEQ ID NO: 40158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcatgtagtcaaggacgacgcatgtgtgt

SEQ ID NO: 40159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcattaggggacagaacgtctccatcccg

SEQ ID NO: 40160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattccagcgcggtcctcaatgctcgcctgcc

SEQ ID NO: 40161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattccatgttgttttgcccgccccgaacatt

SEQ ID NO: 40162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcccgtctggcacggggcgacttggagtg

SEQ ID NO: 40163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattccctaaggcctctacgttctgtaagatg

SEQ ID NO: 40164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattccctcgatgctggattgagggccgggtt

SEQ ID NO: 40165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattccgcttagatcgaacgctctgttggcat

SEQ ID NO: 40166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcctctgtttctgggcggtgacgttgatt

SEQ ID NO: 40167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcctgtcccacggccgcttgaaagtctac

SEQ ID NO: 40168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattccttgacggaaggttagcctcgatcaac

SEQ ID NO: 40169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgaaatgcctctcacggcccgtttttga

SEQ ID NO: 40170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgaaccgaggtaaaaattgtgccaggca

SEQ ID NO: 40171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgacgggggccattggtcactgacggtc

SEQ ID NO: 40172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgagctgtgatcaggtgatacaagtggc

SEQ ID NO: 40173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgccatattcgggcctacgtcttaattt

SEQ ID NO: 40174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcggacggcagggcgcctcctcaacttgg

SEQ ID NO: 40175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcggcactgcaccggcgtcccctcttttg

SEQ ID NO: 40176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcggctcgggaagaacagtagtgtcacaa

SEQ ID NO: 40177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgtggcctaacatgtgatgtactaggtt

SEQ ID NO: 40178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgttgtacaattgatatcttgttcggca

SEQ ID NO: 40179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcgtttgtgaacggcctactgctttgttg

SEQ ID NO: 40180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctaacccttccgatgcgaggggatttcg

SEQ ID NO: 40181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctacggcctgcgtctttctatctcagtc

SEQ ID NO: 40182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctagcaattctttgatctactttcgaac

SEQ ID NO: 40183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctctgaactgcacttacgcaaggtctcc

SEQ ID NO: 40184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctgagagagtttctcttttaccacttac

SEQ ID NO: 40185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctgagcgtcctggtgattatgtttgtgt

SEQ ID NO: 40186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctgggtgatctgtccaaccctttgcctt

SEQ ID NO: 40187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattctggtttcgctgagcccggttcttgtcc

SEQ ID NO: 40188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcttacgcggagcggtgttgtgaatgtgc

SEQ ID NO: 40189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattcttcagtttggccaatttccacagctat

SEQ ID NO: 40190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgaaaccgtatcatcagcgcaggagtgtg

SEQ ID NO: 40191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgaatctagcggctccagagttgctgatg

SEQ ID NO: 40192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgaattgctgcacatgactctttaatttt

SEQ ID NO: 40193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgaccaagcttccgtccagctcgggcatc

SEQ ID NO: 40194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgacccagtttctatcgcgttgtatagca

SEQ ID NO: 40195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgacgtccgttcatgtaaagttacacaca

SEQ ID NO: 40196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgactacgcagcctattctgttatgtcta

SEQ ID NO: 40197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgactggactccgcatattagatgaggtt

SEQ ID NO: 40198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgagaagttcgtggtttggggtcgtttct

SEQ ID NO: 40199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgagagtcgtgctgggggataagcatcgg

SEQ ID NO: 40200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgagccacctttatccttgtagctgctca

SEQ ID NO: 40201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgagccgaagtatgaactgcgggtgtacg

SEQ ID NO: 40202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgagccgtgctgacaagttctcgtcggta

SEQ ID NO: 40203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgagcggcgtttatggattaggcgcgttt

SEQ ID NO: 40204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgatccagcatccatcggtttaaacattg

SEQ ID NO: 40205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgatcccctctcacggttccttgagatgt

SEQ ID NO: 40206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgatcctgttgagctctgttcggtgtggc

SEQ ID NO: 40207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcacaatcttgtgttggtagtttcatct

SEQ ID NO: 40208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcacaccacatgcgcgatgagttgcaat

SEQ ID NO: 40209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcaccgccgcttacagctcggatagcgt

SEQ ID NO: 40210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcacgcgtcgaaagcgtaaaatttttgc

SEQ ID NO: 40211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcactaggccattacaccactgcgctaa

SEQ ID NO: 40212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcagcgcttggagtcccccatactatct

SEQ ID NO: 40213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcaggcgcttgaatatatgtactcggta

SEQ ID NO: 40214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcagtggtcacctatgcctcgtcccgct

SEQ ID NO: 40215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgccgaacgcaataggataccggcgaaat

SEQ ID NO: 40216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgccgggaactcgaaacttggcgcacctc

SEQ ID NO: 40217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgccggttctcgcttaccttcatagcatc

SEQ ID NO: 40218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcgaatggacgacggcgcatagactcac

SEQ ID NO: 40219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcgactcctacgggtgtctcggttaaac

SEQ ID NO: 40220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcggaataaacgccctgacctcaggttt

SEQ ID NO: 40221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcggttggttttgcaaaggatattagtt

SEQ ID NO: 40222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcgtatcttgcttgtggtcggcacgatc

SEQ ID NO: 40223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgcgttgcgctaagtgtgtgcatgtactg

SEQ ID NO: 40224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgctcatatggtggagatgggttgactgt

SEQ ID NO: 40225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgctcctccgatggccttacaaacggtgg

SEQ ID NO: 40226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgctgtggggcgcgggtcatgcgacttag

SEQ ID NO: 40227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggacgtgattaattgggtatccggtata

SEQ ID NO: 40228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggagaagcgtcataagtttgtgtctcgt

SEQ ID NO: 40229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggagaattcgttactatgtcgggaccct

SEQ ID NO: 40230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggaggtacaaatcatcatacggctagtt

SEQ ID NO: 40231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggatgagcagcatgtatgttgccaggga

SEQ ID NO: 40232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggcccctgtacccgcgattggcacgagc

SEQ ID NO: 40233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggccgcataatcgtcgcgttagcaaatg

SEQ ID NO: 40234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggcgtcacgaaccccttcgtctttgccg

SEQ ID NO: 40235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggcgtgccataggtcgggtgctgttggg

SEQ ID NO: 40236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggctaacttattagggcgaatttgtcgt

SEQ ID NO: 40237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggctgtaagatcgcgcgaaagactaggg

SEQ ID NO: 40238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgggagctaacgcctttgtgtgaggcttc

SEQ ID NO: 40239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgggtaagccgacgtgtaaagggcgaggg

SEQ ID NO: 40240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgggtaccggtggagttgtcaccttagcg

SEQ ID NO: 40241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgggtccgtgtcagcggtcaagcaggtta

SEQ ID NO: 40242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggtaaccggcgtataagggtgtttgatg

SEQ ID NO: 40243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggtaagttcatcctgatcctggagttgg

SEQ ID NO: 40244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggtgagagaacgcgacccactggtggac

SEQ ID NO: 40245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggtttcgcgcccattgcctaatgcgtcc

SEQ ID NO: 40246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattggtttgcaggggcatcgaagtattacct

SEQ ID NO: 40247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtaactccgcttaaactttcccctattt

SEQ ID NO: 40248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtacactctttccagttgggttccgctt

SEQ ID NO: 40249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtacgtcgttctgcattgcagcggttgt

SEQ ID NO: 40250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtatggttccagtgcttggagctgcgtg

SEQ ID NO: 40251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtctgtggaggtggtgggtcttctgtcc

SEQ ID NO: 40252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtgagtggcgtcagggaacgttgagttg

SEQ ID NO: 40253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtgatttgactcactaatgcgcttagac

SEQ ID NO: 40254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtgcctccctaccatcgtggcaacctgg

SEQ ID NO: 40255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtgtggctgaaatgcatttattttgctt

SEQ ID NO: 40256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtgttattgtctggtacacgctttcggt

SEQ ID NO: 40257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgtgtttcctggctgttgaagagtaatgg

SEQ ID NO: 40258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattgttcgtggacgatctgctggaaatatac

SEQ ID NO: 40259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttaaccggctatttgcacgccccgtacat

SEQ ID NO: 40260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttaagagcggagtaatcgggtgtgcagcg

SEQ ID NO: 40261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttaatattgcgggttggctcggcaggtag

SEQ ID NO: 40262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttagcttttcgagctcacgtcggtccagc

SEQ ID NO: 40263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttagggggttttttgtttttcttccgagg

SEQ ID NO: 40264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttataatgccggctcttatcgtgatcggg

SEQ ID NO: 40265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttatagtattgattcgttcctttccttga

SEQ ID NO: 40266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttattcgttcactttaggaaggtatcttc

SEQ ID NO: 40267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcactgtgctttaggtccttggcgttgt

SEQ ID NO: 40268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcaggtcagagcgggctaaacaagtatc

SEQ ID NO: 40269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttccagcggtgtgcgttcaatatacatta

SEQ ID NO: 40270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttccggtgcagccattttagccacgcact

SEQ ID NO: 40271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttccgtcatttcaaagctcgcgtcgattt

SEQ ID NO: 40272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcctcacacacagtatttcaccgacttt

SEQ ID NO: 40273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcctgtggaaaggcattcatgtggcgta

SEQ ID NO: 40274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcgatgaggtaagttgtcgctgggaagg

SEQ ID NO: 40275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcggaagcgcgaggggagtacattattc

SEQ ID NO: 40276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcggtaacgtccaggttgcttaacacgc

SEQ ID NO: 40277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttctcttgttactggcgagggatatacgc

SEQ ID NO: 40278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttcttagggttcatcgcaccgtagtgagt

SEQ ID NO: 40279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgatggaatgtcgctctatgttgtgtca

SEQ ID NO: 40280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgcctagttacgcgattatatcacccaa

SEQ ID NO: 40281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgcgatcgacggccttttctgaccctgt

SEQ ID NO: 40282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgcggcgggctatcatggctgtttgtgc

SEQ ID NO: 40283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgctacggtacctaaacaaggagccatc

SEQ ID NO: 40284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgctatgtcatgtcaactcctcatgttc

SEQ ID NO: 40285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttggacggatttgtcactgttggccgtgg

SEQ ID NO: 40286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttggcccgatcttggaagatcctctcgaa

SEQ ID NO: 40287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttggctagttcaatgtttcttgaatgggt

SEQ ID NO: 40288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttggtacatgtaaggtcacgaacgtgatg

SEQ ID NO: 40289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgtacaggattgcagtcggtcttggtct

SEQ ID NO: 40290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgtgtgttttagattcggtgtttgtcgg

SEQ ID NO: 40291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttgttaaagtggggtggtacgtcggttgt

SEQ ID NO: 40292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttaaatggggaaacttattgtgattcga

SEQ ID NO: 40293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttacatggtagccgatatcctcacgccg

SEQ ID NO: 40294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttagtttcacctaacgcaagtataacat

SEQ ID NO: 40295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttcagcacggagattcagtcgtccgtgg

SEQ ID NO: 40296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttccgtggggtaaattgaaagaccagtc

SEQ ID NO: 40297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttcgtatagggagctcattttgtgtggc

SEQ ID NO: 40298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttctggggaggacattcatccctccgtc

SEQ ID NO: 40299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttctttattgatagatctatgctgcggg

SEQ ID NO: 40300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttgagttgcccgccgccgcgtagcattg

SEQ ID NO: 40301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttggattctcatataatataggtctggg

SEQ ID NO: 40302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gattttgtgtcacggcttcttacgctctcaac

SEQ ID NO: 40303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttttaactggtccctcggtttttcacaga

SEQ ID NO: 40304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttttactctagtttgcgcaggcgggtgtg

SEQ ID NO: 40305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttttccttcaattcgttccttcgggggcg

SEQ ID NO: 40306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttttgtcatcagcagttctacaataccgg

SEQ ID NO: 40307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttttgtggcttgacacctcgctttaactg

SEQ ID NO: 40308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gatttttttcacaccgaatgttggttacggcc

SEQ ID NO: 40309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaaacggtctgggttcggtctaatccgca

SEQ ID NO: 40310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaacaggcaccggagtcccacaattgtct

SEQ ID NO: 40311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaaccacgccgtgtgatcgtccctacggt

SEQ ID NO: 40312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaactacggccattcgggcggcgaggggt

SEQ ID NO: 40313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaagaattctcccaccgcgtgttctttgt

SEQ ID NO: 40314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaagaggaatcgcacgctctgggaggtct

SEQ ID NO: 40315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaagtgtcgtataggagcgcagatctggc

SEQ ID NO: 40316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaatctggtttgctgggaagacatcggag

SEQ ID NO: 40317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaatgactatctcctgcgcttgcacacgt

SEQ ID NO: 40318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaatgtttcatagcacggagttgcggcga

SEQ ID NO: 40319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacaaacatgggtggtggggatttgtgcg

SEQ ID NO: 40320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacaatgaccaatatcgcctgcgacctca

SEQ ID NO: 40321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacagagtgaggctgtctacgggggaatc

SEQ ID NO: 40322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacaggtcgagtatgggtttgggggccga

SEQ ID NO: 40323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaccagcatcgcggtagcgtttgggtagt

SEQ ID NO: 40324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaccatgccgtaattgtggggcagcggat

SEQ ID NO: 40325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacccagtagcccgttgcaggatcggccg

SEQ ID NO: 40326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacccgtttcacgtgcgtcatcacgcctc

SEQ ID NO: 40327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaccggctctagcacgtcgtgaccacata

SEQ ID NO: 40328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacgaaactcggctgcatcttaactgcgg

SEQ ID NO: 40329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacgatagtgagctgaatggggcgcttaa

SEQ ID NO: 40330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacgccgccgccgactcccggattgttgc

SEQ ID NO: 40331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacgcgaaatttgatagcattttattttg

SEQ ID NO: 40332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacggcggccttcttcggtctgcaatcgg

SEQ ID NO: 40333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacggtgagcgtccgaggctaggtcggtg

SEQ ID NO: 40334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacgtcgagatattgctttcggccgcgta

SEQ ID NO: 40335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaactaaacaagaccgattgttgttctcta

SEQ ID NO: 40336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaactacacggttgcaatgtgttcgagtcc

SEQ ID NO: 40337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaactaggttcacgtttgcaatttcactct

SEQ ID NO: 40338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaactcagacgagcaacaaatagttatcca

SEQ ID NO: 40339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaactcggtcacctgtttttcccgtcgtcc

SEQ ID NO: 40340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaacttgaacgacggtgcctcgcgcaggac

SEQ ID NO: 40341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagaaggcgcacacgagtagtgccagatg

SEQ ID NO: 40342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagaatccatgacgcttttcgataggcaa

SEQ ID NO: 40343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagagcctatctcgctcaatcttgacagt

SEQ ID NO: 40344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagcgaggagtggctaagcggttaccgcc

SEQ ID NO: 40345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagcgattgtattactccgatgggaccgc

SEQ ID NO: 40346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagcgtacatctcgaatatctccgaagcc

SEQ ID NO: 40347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagcgtccttgacttacggcgtaaagggg

SEQ ID NO: 40348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagctatagagaagggcagggtaacaggg

SEQ ID NO: 40349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaggaatgtgcgctcgacacattcgcgtg

SEQ ID NO: 40350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaggcgtgagcgaaggtacgaccaatctc

SEQ ID NO: 40351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaggctgacatcggccgctcggtgcagta

SEQ ID NO: 40352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagggaccttttcgctggttgtcccgttc

SEQ ID NO: 40353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagggctacgatggacgcgatggtttcct

SEQ ID NO: 40354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaggtaggcttgcggcgttattttgtcaa

SEQ ID NO: 40355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaaggtgaaggggcaaggatcacggttctc

SEQ ID NO: 40356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagtcctccctacctctgcctcccggtga

SEQ ID NO: 40357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagtcgcaaagcttgtacgctcggatcca

SEQ ID NO: 40358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagtctgccgttatgtaaatcgcccattg

SEQ ID NO: 40359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagtgtctgcgtgggatgagtacggacca

SEQ ID NO: 40360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaagttttgtgtagagcgcctggagtccga

SEQ ID NO: 40361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaataaagcagtagacgtttgtcaggtccc

SEQ ID NO: 40362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatacgcgcagggggagagtggcctgcgg

SEQ ID NO: 40363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatagcggaggcagggataggccatatgg

SEQ ID NO: 40364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatagtaccttaccggattcacgccttaa

SEQ ID NO: 40365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatatgatccgtgtatggggccgacctgt

SEQ ID NO: 40366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatcaacggtccgccgcacaggaatcgct

SEQ ID NO: 40367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatcacgtgcttaccttgtgctttacgag

SEQ ID NO: 40368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatcatgaagagctgcgggtctgccatgt

SEQ ID NO: 40369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatctaggaggtggtggcgagtttaatgt

SEQ ID NO: 40370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatgaaacgatgtactgggtctcccgttc

SEQ ID NO: 40371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatgagaggtgtccgcatggtgccgattc

SEQ ID NO: 40372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatggaaacattcagaacgtgcctgcctc

SEQ ID NO: 40373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatggctatgacgaagcgtgtataccagt

SEQ ID NO: 40374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatgtagactacggctattccgctgggtt

SEQ ID NO: 40375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatgtcgactggagctcgtccgggctctg

SEQ ID NO: 40376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatgtgcaacggcctggactctgcctaac

SEQ ID NO: 40377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatgttcacggggtggcagttgcgccttg

SEQ ID NO: 40378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaattagggaatatgagaatcatttgaggg

SEQ ID NO: 40379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaattcagccgggaaagttcctgtacatgt

SEQ ID NO: 40380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaattgattctatgagtccgcctagatctt

SEQ ID NO: 40381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaattgggtccggtttcaaaagagttcaca

SEQ ID NO: 40382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaatttgatagtgttagacggataatgcct

SEQ ID NO: 40383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaaaaagggcacactggagagctggtgg

SEQ ID NO: 40384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaaacgcatattttcttcggctggagga

SEQ ID NO: 40385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaaatcctcgttacaaaacggctagggt

SEQ ID NO: 40386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaacgacgtttcaaacaatatgtcgtcc

SEQ ID NO: 40387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaagaggggccagaaaacgcgagtaaat

SEQ ID NO: 40388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaagtcgggcccatgtgtgttcctgtcc

SEQ ID NO: 40389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaagtctttcatgttatttctacggcgt

SEQ ID NO: 40390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacagcggcacctgagcgttgcattgtg

SEQ ID NO: 40391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacatcagcgctattcccgtcatcgttc

SEQ ID NO: 40392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacaccagcgggtaatgccttgtttcgcgt

SEQ ID NO: 40393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacgaggcggtgcactccaagctagacc

SEQ ID NO: 40394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacggaccgttttctgtagacagtttta

SEQ ID NO: 40395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacggcacgcgctcgacttaagtcagag

SEQ ID NO: 40396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacggcggcaaggggcgaacctaaggac

SEQ ID NO: 40397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacggggaagccggtgaggcagtgtgaa

SEQ ID NO: 40398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacacgtgcgcagccgccatgaaccatcat

SEQ ID NO: 40399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacactcgtcaattccggggctggttttaa

SEQ ID NO: 40400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacagacaacgtgcttctcggtcatcgctc

SEQ ID NO: 40401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacagagctagacgttctgccaattcccgg

SEQ ID NO: 40402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacagataggtaatgcaagtggacccttag

SEQ ID NO: 40403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacagcaaggaccggtgctctggatctggt

SEQ ID NO: 40404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacagcgtacacccccctccagctaagtgc

SEQ ID NO: 40405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacagggtcttttgctgtgggttgctcctt

SEQ ID NO: 40406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacataccggactagaactcgcgtgtggtc

SEQ ID NO: 40407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatagccggacacctgtgcgggtacggt

SEQ ID NO: 40408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatagtctgccggcaggaacaccgtgcg

SEQ ID NO: 40409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatccatgcgatttctggtcgggtccgt

SEQ ID NO: 40410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatcgttacagcaacatagatatggatc

SEQ ID NO: 40411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatctgagaagctatgcgcatcatcgtc

SEQ ID NO: 40412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatgagggcgtgggacttgctgttcgtg

SEQ ID NO: 40413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacatttaagtttctccacaactaccgcaa

SEQ ID NO: 40414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccaaatcagtcaaagggtcgcaaaccca

SEQ ID NO: 40415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccaagggtgaggacttgagtgacggtat

SEQ ID NO: 40416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccacccagtatgcgagtcggctatagta

SEQ ID NO: 40417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccacgtttgggctgttctcgtctccttc

SEQ ID NO: 40418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccagctaccgtggaatgtttcggcgtac

SEQ ID NO: 40419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccagtaacaattcgggctagccctaact

SEQ ID NO: 40420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccagtgacttcgtattaggcagcacctg

SEQ ID NO: 40421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccatcgctgtatgctcggagcaacacgg

SEQ ID NO: 40422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacccagacctctgttgcactgcagctcca

SEQ ID NO: 40423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccccacacccaaatgctatagccacgat

SEQ ID NO: 40424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacccgatgtcacaaccgtttcgtcctggg

SEQ ID NO: 40425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacccggtcagcaatcctgtgaatctggcg

SEQ ID NO: 40426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacccgtaaaatagtatctctactatgggc

SEQ ID NO: 40427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacccttctccctttggtggtacgaggggc

SEQ ID NO: 40428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacccttgggcaatacgtgcaggagtgggt

SEQ ID NO: 40429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccgacctgattaggttgttaagggtcac

SEQ ID NO: 40430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccgactacttccacgtacatgttggtgg

SEQ ID NO: 40431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccgcactttgcttccctcacgcgaagga

SEQ ID NO: 40432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaccgcagttctgcactgtctagtggcgcg

SEQ ID NO: 40433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacctcaatggtcacctttgcctcgcccta

SEQ ID NO: 40434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacctcgcacatcactggcggatcgagccc

SEQ ID NO: 40435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacctcgcacgcctttgatcttttaccgcg

SEQ ID NO: 40436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacctctgaggcggtatggacgagggccga

SEQ ID NO: 40437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacctttaagctcaatgatttttcagctat

SEQ ID NO: 40438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgaacaaagtccacggttacaagaggag

SEQ ID NO: 40439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgaacttaagcgttaccatttccctgac

SEQ ID NO: 40440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgacctctactaccaccgacgggtgctc

SEQ ID NO: 40441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgacgagtatcgggctttgtctagtggg

SEQ ID NO: 40442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgactaccatcccagtgtgtgtgtaaac

SEQ ID NO: 40443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgagtagatcacaaaggtttttggcccg

SEQ ID NO: 40444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgcaagaataggatgaggtatccgttgg

SEQ ID NO: 40445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgcggggaaggcggagcatctcattctc

SEQ ID NO: 40446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgcgttgtcgattaaaccgccgttgcgg

SEQ ID NO: 40447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggaccacaacatctgatttgatgctca

SEQ ID NO: 40448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggaccagcttggtcggtcgtgactaag

SEQ ID NO: 40449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggaccgcttgcctgaccgccagttgta

SEQ ID NO: 40450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggcagacgaggagtccgacactcaaac

SEQ ID NO: 40451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggccggaatcttattcggctaacccca

SEQ ID NO: 40452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggcggtagcgttcgtcgcaattcattg

SEQ ID NO: 40453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggcgtcaccctcgtgccattctcggag

SEQ ID NO: 40454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggctccacggggctaggttgggttggt

SEQ ID NO: 40455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggctctccgcactgtactgttgcgtgg

SEQ ID NO: 40456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgggccttgtaagttcctgtcggtcgcg

SEQ ID NO: 40457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgggcgagataaatgggattatatgcgg

SEQ ID NO: 40458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgggtccgatcgcctgcttttaccctaa

SEQ ID NO: 40459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacggttggatgcagggtagtgccgaacaa

SEQ ID NO: 40460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtacccaaggctcatacacttgccatc

SEQ ID NO: 40461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtacgcaagagtaacgaacgcgtggtc

SEQ ID NO: 40462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtagaatgaccccttgtcagtactgca

SEQ ID NO: 40463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtatctcgaccgggatgatcagactgg

SEQ ID NO: 40464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtcacaacgtcggtatcactgcggcgg

SEQ ID NO: 40465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtcaggctcaaccggctcttcgtatct

SEQ ID NO: 40466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacgtgcgtgggagggtgaccctgacttgg

SEQ ID NO: 40467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactaagcaacgttcagaaggtggtgttcc

SEQ ID NO: 40468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactacagtgaggccaccttacacatgggg

SEQ ID NO: 40469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactacgtcgttctggcgcgatctttcttg

SEQ ID NO: 40470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactactagggcgtagatgctgaccacatt

SEQ ID NO: 40471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactactccggatgatcgtctggcggcggc

SEQ ID NO: 40472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactagtttgtgcttactccatcccgtgga

SEQ ID NO: 40473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactatagcaaggccgcgcaggtgatatcg

SEQ ID NO: 40474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactcagcgcagctcgtgcaggaagggcta

SEQ ID NO: 40475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactcagtccttacgtcggtgtgcgtgttt

SEQ ID NO: 40476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactccattgtttcagtcagttgtcgcaat

SEQ ID NO: 40477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactcgcagaaatgggagctgtattattcg

SEQ ID NO: 40478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactcgcggcaattaaccctcgtcatcaga

SEQ ID NO: 40479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactctgagtatgatgcagttctacaccgg

SEQ ID NO: 40480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactcttcactctgcggggcggggtcaagc

SEQ ID NO: 40481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactgaagcgaacaatgcagggtcatatgc

SEQ ID NO: 40482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactgacgcgcgtaatcgcctagtttattg

SEQ ID NO: 40483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactgacttaccctaactgtcgtcgttcga

SEQ ID NO: 40484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactgatgagctttcccttttcgtgatcta

SEQ ID NO: 40485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactgcacccgtcaatgccccaatcgtcgg

SEQ ID NO: 40486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactgcacgactttcgctggggcctaggtt

SEQ ID NO: 40487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactggcttatcgcccgaaggccgctgtct

SEQ ID NO: 40488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactggtagctcgttgataagggttcttgg

SEQ ID NO: 40489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttacaggcttggcagactatggtgatc

SEQ ID NO: 40490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttagggtgacggtatcgcttgtacccg

SEQ ID NO: 40491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttcgctccgaggtgtgcgtctgcctgt

SEQ ID NO: 40492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttcgggggcgatggttgtagatcgtta

SEQ ID NO: 40493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttctctagcttcccaaaagtcacatcg

SEQ ID NO: 40494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttgcagttacgaagattattatttgga

SEQ ID NO: 40495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaacttggtgtcgctacttccggttgacttt

SEQ ID NO: 40496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaactttcattatgtagcgcatcggccttgt

SEQ ID NO: 40497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagaaatcgggtgtgtaacgatcgagcagg

SEQ ID NO: 40498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagaagactaactttagaaaatttgccgcc

SEQ ID NO: 40499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagacagtggggaggacttccgggcgtgag

SEQ ID NO: 40500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagaccagctgagtctactgacgcgcgggg

SEQ ID NO: 40501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagacgatcggactatcgagcgcatggaac

SEQ ID NO: 40502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagacggagagcatgagatggattgtgatg

SEQ ID NO: 40503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagactgtccgaggttatgtcctgctttag

SEQ ID NO: 40504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagagaatcatgcacgctatcacctaacgg

SEQ ID NO: 40505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagagacggcatcatctacccagttatccc

SEQ ID NO: 40506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagagcaccaacattggcgacatgcggctt

SEQ ID NO: 40507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagaggagggatagaattctcagcaaacgg

SEQ ID NO: 40508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagaggtaagctcccaacgactcagaaagg

SEQ ID NO: 40509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagaggtgtgggtcctggagcggccattcg

SEQ ID NO: 40510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagagtatgcaacacgtaggtgacgcgaga

SEQ ID NO: 40511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatactaacgtaagctaccccgtattct

SEQ ID NO: 40512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatatgatagatccatcgtcaccccccc

SEQ ID NO: 40513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatgccgtaggcaacggtggcgccagtc

SEQ ID NO: 40514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatgcgcagctttcatcaggtacacatc

SEQ ID NO: 40515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatggtcggtcgatttgggtcggttgcg

SEQ ID NO: 40516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatgtcaccaggcaaactgttccgctcc

SEQ ID NO: 40517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagatttaccgcttctatgcgaggcagatc

SEQ ID NO: 40518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcaagcttcttacacggagatgtcgtat

SEQ ID NO: 40519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcacagtgttacgcggtcgggtataggc

SEQ ID NO: 40520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcacggtcgaccatacgtttcaatgccc

SEQ ID NO: 40521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcagcaggggtcctcattcgaatcggga

SEQ ID NO: 40522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcagcagtgatattcttcacggcggttg

SEQ ID NO: 40523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcagccgtccgattcgatctgcattata

SEQ ID NO: 40524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcagttccagggtccggcatcccgcggt

SEQ ID NO: 40525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcatacgtcagtcattcgcgattcttag

SEQ ID NO: 40526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcatcttgcactcgcaaaacgccgctgt

SEQ ID NO: 40527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcattcttcacatagaagcttagggatg

SEQ ID NO: 40528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcccgattcagggacctccctttgtaac

SEQ ID NO: 40529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagccgtgccagaatagagtgtgagtgagc

SEQ ID NO: 40530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcctaaacgcgccgatcgctttcattgg

SEQ ID NO: 40531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcgacgtcgcgttaagattggtaaccga

SEQ ID NO: 40532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcggagaagaattcccgggtcgacagtc

SEQ ID NO: 40533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcggcaaagccaaggacttttggtgggc

SEQ ID NO: 40534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcggcgtgagagggcacgttgcattagc

SEQ ID NO: 40535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcgggacgggggtttgatttgtttgcgc

SEQ ID NO: 40536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcgggcgggggatgaatcagtgctgatg

SEQ ID NO: 40537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcggggtaaacgtgcactctccagtttg

SEQ ID NO: 40538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcggtcatcggtcataatacatctaggg

SEQ ID NO: 40539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagcgtctaaggggtctgccgaggccttgg

SEQ ID NO: 40540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagctaatggccgtccgcacatgagctgtg

SEQ ID NO: 40541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagctaattctctgttgttcttatggctcg

SEQ ID NO: 40542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagctattcccgtacgtacccctcgtttct

SEQ ID NO: 40543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagctgacctaaacgacccataaagcagac

SEQ ID NO: 40544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagctttggcttaatggttccgcagtgtcc

SEQ ID NO: 40545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggaccagcaaagggcgcttcccacgcac

SEQ ID NO: 40546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggacttcggtatgaagttctgaggctcc

SEQ ID NO: 40547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggagctatctcatgccactgttctggtc

SEQ ID NO: 40548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggagggagaagcggattttttccctggc

SEQ ID NO: 40549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggagttgtactggtaatccgtttcgtgc

SEQ ID NO: 40550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggatcggtatgccttaggcctatgcggc

SEQ ID NO: 40551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggccggcgttgcaaccaggaagctgatt

SEQ ID NO: 40552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggcgagtcggaaagtgttaaacgatcgt

SEQ ID NO: 40553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggcgcgtaaacgagcacgcaacgccccg

SEQ ID NO: 40554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggcgtacggtatggttcgcagttggtgg

SEQ ID NO: 40555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggctcggccaactcgaccctgagcacgt

SEQ ID NO: 40556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggcttcgtcgtccatcatacgtctgcgc

SEQ ID NO: 40557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggaattcacccaggtccgcgcggtgca

SEQ ID NO: 40558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggacttctgtctccaaagtattgagtt

SEQ ID NO: 40559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggaggcagaaaacagggcagcaatccg

SEQ ID NO: 40560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggagggcttaccgcgtggcaaccttcc

SEQ ID NO: 40561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggaggtttctttgtaatttattccgac

SEQ ID NO: 40562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggattacggcatgccgcgattgttggg

SEQ ID NO: 40563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggccgtcgtttctggcttgctatgtaa

SEQ ID NO: 40564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggcgagtccctttaggtccgacccgaa

SEQ ID NO: 40565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggggatccaggcatttgcccggcgccac

SEQ ID NO: 40566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggggccaccgcggaagcgcgggctgtct

SEQ ID NO: 40567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggggtcatcgtgtgtaatcgacctgtcg

SEQ ID NO: 40568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggtagttcctccatgcgatcctgtacg

SEQ ID NO: 40569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagggtcgcgggttaccatcgtagcagccg

SEQ ID NO: 40570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggtagcgtacacgttaatcgacaacgcc

SEQ ID NO: 40571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggtcccccgtgttgaaatctaccttgca

SEQ ID NO: 40572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggtgaatggggatcacggagacgactat

SEQ ID NO: 40573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggttgaatgatttgggcttaccggtatc

SEQ ID NO: 40574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaaggttttgttctcccagtactgaggacta

SEQ ID NO: 40575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtaacgttaccccatcgtgttttgcaaa

SEQ ID NO: 40576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtacaatgacgctatattccaaagtgcg

SEQ ID NO: 40577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtacctggcagtcggatgagatagcgcg

SEQ ID NO: 40578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtccgcggatttttgacgattcttcctg

SEQ ID NO: 40579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtcgggggggaagcaaacgtagagcact

SEQ ID NO: 40580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtgacaggtggtgcaccgggaagctagg

SEQ ID NO: 40581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtgaggacattcacttccctttgccttt

SEQ ID NO: 40582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtgagggcggtccgcggattcggatagt

SEQ ID NO: 40583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtgcacgccgaccggtaaaaacgtacgc

SEQ ID NO: 40584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtgcgggaacagatcgtgatggcagagg

SEQ ID NO: 40585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtgggcgctttgcacagtcactcttcgg

SEQ ID NO: 40586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtggggccaagctggtgagctttaagag

SEQ ID NO: 40587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtggtcgaacatcactcaggctacgtgt

SEQ ID NO: 40588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagttagacgactaggcacgaagctggagg

SEQ ID NO: 40589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagttagttcgtcctagcgcttctggtcgg

SEQ ID NO: 40590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagtttacgaaactaggcgcaaatgcacgg

SEQ ID NO: 40591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaagttttaccgattgctcaattctctatgg

SEQ ID NO: 40592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaataactgtatgctaagtgcgggtcccggt

SEQ ID NO: 40593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaataagatcccgtgcttgaccggcacttgt

SEQ ID NO: 40594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaataatcgccctcgtcatgtgatgggcgcc

SEQ ID NO: 40595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaataatgctgttcaagagagcatgtggcta

SEQ ID NO: 40596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaataccgagatttcaaaggtagtgcgtcgt

SEQ ID NO: 40597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatacgaccagttcgagcgagtgactggcg

SEQ ID NO: 40598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatactaacgtgaccggcgactccgttcgg

SEQ ID NO: 40599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatactactagttatcgtcaactccgaagg

SEQ ID NO: 40600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatactgttggaatcttggccggaagtcgg

SEQ ID NO: 40601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatacttccatcttcttcaactggcgtagg

SEQ ID NO: 40602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatagggggcgggggaactgaattgaggtg

SEQ ID NO: 40603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatatcccgtgtttcagagccctggtgttt

SEQ ID NO: 40604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatatcggaatgccagcgatataataagcg

SEQ ID NO: 40605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcaagaaagccgtcccagtcagaaggtc

SEQ ID NO: 40606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcacaatgactgcatggggatgggctgg

SEQ ID NO: 40607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcacgggcgcctctcacttagcggtgag

SEQ ID NO: 40608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcagagccggtctaaggaaaattgcctc

SEQ ID NO: 40609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcatttgttttgttatatcgctgctggt

SEQ ID NO: 40610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatccagcggggccgtggcggagaacttcc

SEQ ID NO: 40611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcgaccatgcatggttagatgtcgggtg

SEQ ID NO: 40612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcgcatgctggtgcagtttaagagtacc

SEQ ID NO: 40613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcgctagatctatgcttccgatgctgct

SEQ ID NO: 40614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatcgtaacggtcagaagcctgatgttttc

SEQ ID NO: 40615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatctaatcttctaattatgtttatcccaa

SEQ ID NO: 40616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatctactctgtttgcggtcaagccgggca

SEQ ID NO: 40617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatctagttatgatcacttacgtatctcga

SEQ ID NO: 40618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatctcgtgcgtcaattcagcaggggtgga

SEQ ID NO: 40619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgaacggggagtatgacggacctcaacg

SEQ ID NO: 40620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgaactatcctgttcgccaccctttcac

SEQ ID NO: 40621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgacaaacctgcttggggcaccctctgc

SEQ ID NO: 40622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgacggtttgaattgaaccaggacaaac

SEQ ID NO: 40623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgagatctttaattactctgacggggtc

SEQ ID NO: 40624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgagcggtccgcagctcgcatcgagttc

SEQ ID NO: 40625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgagcttatttgcatggacaggtgatac

SEQ ID NO: 40626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgatccaacagtccgcatgctgcatggc

SEQ ID NO: 40627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgattctgaggggttagtaagagggctc

SEQ ID NO: 40628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgcagcgttaccacggccgtgaatcggg

SEQ ID NO: 40629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgcccagacgatgtttatcttgcttatg

SEQ ID NO: 40630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgcgggctggacacgtatgtgcagtagg

SEQ ID NO: 40631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgcggtctgcgagtcgtcagtatggggt

SEQ ID NO: 40632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggagagacttagggtccacggcttgct

SEQ ID NO: 40633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggatcgaggttatagcacgtaggcccc

SEQ ID NO: 40634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggcaatgggcttttccagcagaaggag

SEQ ID NO: 40635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggcaggcttcttacgggttgcggcaaa

SEQ ID NO: 40636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggccggtcttggtgatcgtgttggccg

SEQ ID NO: 40637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggcttaggaggttgattagctcgtttc

SEQ ID NO: 40638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgggaaacacccgctgaagagctactcg

SEQ ID NO: 40639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgggacaagacattcgatctgttcaccg

SEQ ID NO: 40640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggggaagctataggatctctgagggag

SEQ ID NO: 40641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatggtgtttctcggctcaaacttcatcgc

SEQ ID NO: 40642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgtcaccgagtcgacttatttgtatatg

SEQ ID NO: 40643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgtccggcggaaccgcaagtcctagtgg

SEQ ID NO: 40644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgttctcctgctgatcacctcgcctagc

SEQ ID NO: 40645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatgttctggggagccacggattacttgtt

SEQ ID NO: 40646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattagaggtggaaggagcccgagaggccg

SEQ ID NO: 40647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattcacaacgctgcttacgtcccatgcgg

SEQ ID NO: 40648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattcaggaactgtggaacggacaatattg

SEQ ID NO: 40649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattccatagagttaggcgtgcgtggggat

SEQ ID NO: 40650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattcgtgggacggaagatctgattggttt

SEQ ID NO: 40651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattctaccttatgcgtggccgattctgtc

SEQ ID NO: 40652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattgacgtagtatgagtactatgcgtgcc

SEQ ID NO: 40653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattggataacgcctccatgaaaggtaacc

SEQ ID NO: 40654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattggtagtggcacaacgggcggccatgg

SEQ ID NO: 40655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattgtcgatatcggacattagacgacgtt

SEQ ID NO: 40656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattgtgtgaatgccgggccgtgcgttcaa

SEQ ID NO: 40657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattgttttgggcggttagtgttgctggat

SEQ ID NO: 40658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatttcaggaacaagggcggttttaagcgc

SEQ ID NO: 40659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatttggtgggaagtcggtaatggaggttt

SEQ ID NO: 40660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaatttgtatgtctgtcacttagtgttaccc

SEQ ID NO: 40661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattttagtcagctaggtctctcttaggtt

SEQ ID NO: 40662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaattttcgttgatcccatctatacgtggtc

SEQ ID NO: 40663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaaaagcccagagcgccgcgcgagtgct

SEQ ID NO: 40664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaaccactcaacagctagtagggacccc

SEQ ID NO: 40665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaacggacccacgccgtccgcgcagctg

SEQ ID NO: 40666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaatctaagtagctcggatcgaaagtca

SEQ ID NO: 40667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaacaaaggggctttattatctattcgat

SEQ ID NO: 40668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaacacgaacttccctgactgtctgggac

SEQ ID NO: 40669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaacacgtgtcaccatagactgagtcaca

SEQ ID NO: 40670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaacatatattgtattagccacagtagag

SEQ ID NO: 40671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaccaggacgggggagcaccgattcagc

SEQ ID NO: 40672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaccgctcgcctacgtggatgcaattcg

SEQ ID NO: 40673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaacgatcgtgctaacttgcggactgaca

SEQ ID NO: 40674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagagatcagggcccgcctcatgggtgt

SEQ ID NO: 40675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagcagtggatgcaaacggcacacagtg

SEQ ID NO: 40676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagccgggcgcagcgtgctctacctgta

SEQ ID NO: 40677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagcggccatatcattacctcgccagta

SEQ ID NO: 40678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagcgtgaatagattccagttatgttac

SEQ ID NO: 40679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagctgggctccgtgtcacccatgtttg

SEQ ID NO: 40680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaggaactatcaggagtttgtctaaggg

SEQ ID NO: 40681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaggatacactccgtcagctaggatacg

SEQ ID NO: 40682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagggacatttggtacgggccgtcggag

SEQ ID NO: 40683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaaggtccccatgaactgaaccgttagcg

SEQ ID NO: 40684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaagttcgaatggtgacttcggttttcgc

SEQ ID NO: 40685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatacactgcggacaacttcgaggacgt

SEQ ID NO: 40686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatacgctcttcccagagtccctctcga

SEQ ID NO: 40687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatccatgacggcttcacttgtgggaca

SEQ ID NO: 40688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatctggttggcttgacgagacgggttc

SEQ ID NO: 40689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatgatggcagcgttgtgtcttcaacga

SEQ ID NO: 40690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatgtcgtcctgttcaatcaagtgtatt

SEQ ID NO: 40691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaattggcggcctgccgggttcacgtttg

SEQ ID NO: 40692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaatttctgtaggcagttctgttggtcgt

SEQ ID NO: 40693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaattttaacggtccgttgacatcttgct

SEQ ID NO: 40694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacaaccacatctgtaaggaggtgctccg

SEQ ID NO: 40695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacagcctcaattgagcgggtaatacttt

SEQ ID NO: 40696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacagccttgcacaacctacatgggatcg

SEQ ID NO: 40697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacagctgagtggtggacggttattggac

SEQ ID NO: 40698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacaggacggcgtagttatcgttccagct

SEQ ID NO: 40699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacaggcccgatatccccgtggagatgcg

SEQ ID NO: 40700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacaggtattttgtaggtcacgcgctaac

SEQ ID NO: 40701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacataccgtagagcaagactcgcctcgc

SEQ ID NO: 40702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacatatcgcgcccgatttgcgacgactc

SEQ ID NO: 40703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacatcggtttttcacggttctttgcccc

SEQ ID NO: 40704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacattcttcctcgccatgacacgggctg

SEQ ID NO: 40705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaccatgagcaacagccaccgggagtccg

SEQ ID NO: 40706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacccagccgccggaatgctacgcttgct

SEQ ID NO: 40707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacccgcaccgagcacctccggaaatctt

SEQ ID NO: 40708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaccgcgcttaactaggtcatcactgggc

SEQ ID NO: 40709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacctagatgcgatgcgtggacactttcc

SEQ ID NO: 40710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacctagcaggttgaaccgcaggccggta

SEQ ID NO: 40711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgagaaccccgcccacattcgattttt

SEQ ID NO: 40712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgcgggacagcattatctcggcctgtc

SEQ ID NO: 40713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgggaccttgaatcactggatcgcaca

SEQ ID NO: 40714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgggggtattttggtaggtctctctgc

SEQ ID NO: 40715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgggtagacgcatattctccgctccgg

SEQ ID NO: 40716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgtaggtcagcactctgagcacactta

SEQ ID NO: 40717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacgtgacgagtatctcgggggttcggca

SEQ ID NO: 40718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacactatcaccaccgccagttggttctcgg

SEQ ID NO: 40719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacactcccggttttcttaaccctccgagaa

SEQ ID NO: 40720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacttcgacaaacatttgctgtctaggtc

SEQ ID NO: 40721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacttgacagacaataaacgcctattgtg

SEQ ID NO: 40722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacttggagtgcacaaattttcccccgcc

SEQ ID NO: 40723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacacttgtgttcgtgttaatcgaatcctgg

SEQ ID NO: 40724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagaacagagagaagtacattccgaagta

SEQ ID NO: 40725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagaaccggagagaccatagaaacggcga

SEQ ID NO: 40726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagagcttgcggggtcatactcacattcg

SEQ ID NO: 40727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcagtattatctaaaaactggtgcgtg

SEQ ID NO: 40728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcagtcttacgcacatcgagtcattca

SEQ ID NO: 40729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagccggcatgtaaaaacagctgacatgc

SEQ ID NO: 40730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcgacaggtttagctatgagcaagtgc

SEQ ID NO: 40731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcgcgagatatcagggccgcctttgtg

SEQ ID NO: 40732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcgggcagcttccgtagaggggatccc

SEQ ID NO: 40733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcggggcttttgtgactcctcacgtac

SEQ ID NO: 40734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcgtcgcgatgtggacgtaaagtgccg

SEQ ID NO: 40735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagcgtcgtcccggtctgtagggctatct

SEQ ID NO: 40736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagctactcctgaatttttgtgttctcat

SEQ ID NO: 40737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaggcacgatcggtggtagctcgatcgac

SEQ ID NO: 40738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaggctctgagaggtcgaggacctgcatc

SEQ ID NO: 40739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaggctgtagcttccgttctgcgttcggt

SEQ ID NO: 40740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagggcaggcgggcgcgtatcttagcgcg

SEQ ID NO: 40741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagggctatgaaccacgctgtgaatggga

SEQ ID NO: 40742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaggggcgccggagatagtcatgcggtct

SEQ ID NO: 40743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagggggaccggaggggctctcacccatt

SEQ ID NO: 40744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagggggctcttttaaatgacggtttctg

SEQ ID NO: 40745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagggtcaattagagaccgctgatatggc

SEQ ID NO: 40746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaggtctggaaacactattgcagtgaggt

SEQ ID NO: 40747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacaggtggctgctcatctaatactccgccg

SEQ ID NO: 40748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagtgcatcatgcttgtcacagtcccgtc

SEQ ID NO: 40749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagtggtccaatggaaaatagagatatcg

SEQ ID NO: 40750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacagtgtcgtcgcgagcttgtcgctctagg

SEQ ID NO: 40751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacataaggtggaacaggatctcgtgtgggc

SEQ ID NO: 40752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatagcggtgtattatgaacggtcctagt

SEQ ID NO: 40753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatccccagaggtttcaggttttggaaga

SEQ ID NO: 40754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatccccagtggggcggtcttctcaggat

SEQ ID NO: 40755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatcctgtccactacgtcggtcgttgttt

SEQ ID NO: 40756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatcgcctgccattgttcaatcaatccgt

SEQ ID NO: 40757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatctaccatggttcgatggacgcctgtg

SEQ ID NO: 40758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatctctgcgtacaaccgccaacgctgcg

SEQ ID NO: 40759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatgcaagtcaccggggatttggggatgg

SEQ ID NO: 40760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatgttcaggatcgcgggctaatgacgtc

SEQ ID NO: 40761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacattagaagtgatcttgcgtctctcagct

SEQ ID NO: 40762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacattgggttgccgcaatgctatttgagtg

SEQ ID NO: 40763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatttaaccgggggtcatctctggaggcc

SEQ ID NO: 40764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatttaccttacggctgaccgccgactcc

SEQ ID NO: 40765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacatttttcctttcggccggagaaaaaggt

SEQ ID NO: 40766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaaaacacagtttctttgcacccgctag

SEQ ID NO: 40767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaaacacttgctaccccgatgtgcgacg

SEQ ID NO: 40768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaaagcgggtttcgtctcccggtactgc

SEQ ID NO: 40769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaaaggaccaagggtccctcgggcagtg

SEQ ID NO: 40770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaagaggcttgcaggtccacgcactgct

SEQ ID NO: 40771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaatcgagctagggatagtgtcggttat

SEQ ID NO: 40772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccacaccgtgcggtcagcattagccgaaa

SEQ ID NO: 40773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccacagcaagcctgcccctcgtgtttgtt

SEQ ID NO: 40774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaccggccttccccaattgcgtccccgt

SEQ ID NO: 40775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccacgactttttccatgcaacggttgggg

SEQ ID NO: 40776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccacgcacaggctgaaatgtctctcgaaa

SEQ ID NO: 40777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccacggtatttgggatgtcacacacaggg

SEQ ID NO: 40778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccacggtcagtcgggtcaagtgggccgtc

SEQ ID NO: 40779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccactaagtcaaactttttctgtggggtc

SEQ ID NO: 40780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccactatgtcgtttagtcgtgagcgctca

SEQ ID NO: 40781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccactcgcttattccaaccctagactgag

SEQ ID NO: 40782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccactcggctagtagaacagtgttattgc

SEQ ID NO: 40783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccactcgttcgtatgtcacacctcgtcac

SEQ ID NO: 40784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccagatagatgggcttgacaatatgaact

SEQ ID NO: 40785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccagctcgccaggtattgtttcgtgtccg

SEQ ID NO: 40786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccagctgccaaggcggcacttcatcgcgc

SEQ ID NO: 40787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaggctatccttaggttcctcgcctcac

SEQ ID NO: 40788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccaggggacgcttcgataacccctgtacg

SEQ ID NO: 40789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccatcagcgtcaatagctggggagggacc

SEQ ID NO: 40790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccatcccaaggactcccgttccgtagttt

SEQ ID NO: 40791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccatcccaccacgcactgaagtacccgtc

SEQ ID NO: 40792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccatgctaggtaacaggcccagagctccg

SEQ ID NO: 40793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccatgtggactggccgcaagttctatcgg

SEQ ID NO: 40794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccaaaacctgattaggtagactcatcct

SEQ ID NO: 40795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccaactgtaacaagctaacggacgattg

SEQ ID NO: 40796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccacacccagagtggtactgcttgtggc

SEQ ID NO: 40797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccacgctagcccacttggctttgggtag

SEQ ID NO: 40798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccagaacggaagccggttatatagcgat

SEQ ID NO: 40799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccagatcctcgattggttgaggaaacga

SEQ ID NO: 40800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccagggcgagatgaagtccgcacttacg

SEQ ID NO: 40801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccagggttagagtatccacgctctgttg

SEQ ID NO: 40802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccaagtttacacccgtatgcggatcaa

SEQ ID NO: 40803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccatttgccgcaacggtcctttgagct

SEQ ID NO: 40804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccccggccggtcgagactcgtggtagac

SEQ ID NO: 40805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccgaggattacctttacggctatcgtc

SEQ ID NO: 40806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccgataattgtggagttgcgcgctttt

SEQ ID NO: 40807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccgggaagcgcagtctgatctggtctc

SEQ ID NO: 40808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccgggtcctcatatctgataccctccc

SEQ ID NO: 40809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccccgtctggacgcgccaacaatgtggat

SEQ ID NO: 40810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgagctatggccactgtcccacatcat

SEQ ID NO: 40811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgatttgcatgccaacggccacggtac

SEQ ID NO: 40812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgcatgggcatggcatccacgcttctc

SEQ ID NO: 40813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgcctaggttcgtacccaaggggctct

SEQ ID NO: 40814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccggactgtattatgcttagcggtgttg

SEQ ID NO: 40815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccggtgccgtggagtggcgacgtttacg

SEQ ID NO: 40816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgtaggggatcatacggttaaatggcc

SEQ ID NO: 40817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgttcgttgtttccggtccgaatgatc

SEQ ID NO: 40818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccgttggttgagttcagcctagtacgtc

SEQ ID NO: 40819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccctaagccggcatgaaccgctatcatcc

SEQ ID NO: 40820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccctcggcttagcggtttgagttcatcta

SEQ ID NO: 40821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccctctccaacaggcctccatcgacccga

SEQ ID NO: 40822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccttcgatctcaaggcaactggaaccac

SEQ ID NO: 40823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacccttggggatctcgatgagtgttggtgg

SEQ ID NO: 40824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgaaaaccccggaacgctgcttttggtc

SEQ ID NO: 40825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgaaccatgcagcttgtagtccgggggt

SEQ ID NO: 40826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgaatattggtaacggctgcgtccctgg

SEQ ID NO: 40827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgaattgggtggagtggtgtcgtggggg

SEQ ID NO: 40828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgaccgagtatgctttgagccggattac

SEQ ID NO: 40829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgagttgcagtcggttgtgcggatgtca

SEQ ID NO: 40830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgatcaacgtatcgaacccaccgagttg

SEQ ID NO: 40831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcacaccctcatggcctgctatgttgg

SEQ ID NO: 40832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcacatcgggtgaatcgacttcgggta

SEQ ID NO: 40833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgccgcaacaggcgtccccgcagcgggc

SEQ ID NO: 40834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgccgcggtaactcgacaggatagcaga

SEQ ID NO: 40835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcgcaaccgggattatagtactccgct

SEQ ID NO: 40836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcgccgcaagatcgttggcagtccgtg

SEQ ID NO: 40837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcgcggaaccagaagtcaagctgcagt

SEQ ID NO: 40838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcggaaaacatcgatcaactacaccgg

SEQ ID NO: 40839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgcgtcctggggcaggagccgaatgggt

SEQ ID NO: 40840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgctatacaaaggccgtgtgcgatattc

SEQ ID NO: 40841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgctcagaagagacgcgatagagtaaga

SEQ ID NO: 40842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgctgtgggtttactgtcggtgagccct

SEQ ID NO: 40843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggagggatgaattaggagcacttgtat

SEQ ID NO: 40844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggataacgggtggacttgcgtgctgga

SEQ ID NO: 40845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggatgctctcctgatttccatgcgcta

SEQ ID NO: 40846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggatggtgtatatgtgtatgtcgctga

SEQ ID NO: 40847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggcacattggttttcccgacgagtgtg

SEQ ID NO: 40848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggcatatatgtgaggctcgcactcgag

SEQ ID NO: 40849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggcgtacatgagggcccattcacattc

SEQ ID NO: 40850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggctagttgtggcgctgctttacggaa

SEQ ID NO: 40851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgggatctcgttacgttagttggaagcg

SEQ ID NO: 40852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgggcaccctccgttcttttaggaagat

SEQ ID NO: 40853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggggccgactaggttaatgtgtcttgt

SEQ ID NO: 40854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgggggtggatggcggttcaggtaacca

SEQ ID NO: 40855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggggtcccatctggcaggttgtgtgtc

SEQ ID NO: 40856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggtaagcttgtctacacgaatatccgt

SEQ ID NO: 40857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccggtccgacaaggtgatcaggttttccc

SEQ ID NO: 40858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgtacatgggcttaaacagttggttcta

SEQ ID NO: 40859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgtacatgtttttcgtatacggggtagt

SEQ ID NO: 40860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgtcgatcgacgcctagatctgacctgc

SEQ ID NO: 40861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgtcgtggcgatcctacaacagccggcc

SEQ ID NO: 40862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgtctgttgtgggcaacggattcccgtc

SEQ ID NO: 40863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgtgccccatgatggcagagtttagagc

SEQ ID NO: 40864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgttattcgatgcagtacgttgatcagc

SEQ ID NO: 40865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccgttgtacggttcgggcctgtcgtacgg

SEQ ID NO: 40866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctacaaacttataactgccaggagttgc

SEQ ID NO: 40867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctagcccctgtacacccgccaactggag

SEQ ID NO: 40868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctaggagccatgggtgcgaacctggtgc

SEQ ID NO: 40869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcactacgatgtaaagcatttgcccgt

SEQ ID NO: 40870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcactcgactttgccaagttagacggg

SEQ ID NO: 40871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcatcacaggggaggcggccctgcgcc

SEQ ID NO: 40872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcatggcaaactccaggcttcgacggg

SEQ ID NO: 40873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcgatctgataaaaatatctataggat

SEQ ID NO: 40874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcgcctgcccagtgctcgccaaggtgg

SEQ ID NO: 40875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcggattcaggtgggagttctcctgct

SEQ ID NO: 40876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcggtcgcaacaagtctcttttcacgg

SEQ ID NO: 40877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctcgtcctcactttttaaatgcactcgg

SEQ ID NO: 40878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctctcaatcgaggtatagaacgctggta

SEQ ID NO: 40879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctctcgacccctctcttttcccgagcgt

SEQ ID NO: 40880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgaagcgctaggggtatgatccactgt

SEQ ID NO: 40881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgcatgcgttaatgcgtgccacatgcg

SEQ ID NO: 40882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgcattgagcgagctaaaatttgtgat

SEQ ID NO: 40883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgcctcctttgactgcaccgcgtgata

SEQ ID NO: 40884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgcgaacccagcccctctggctttgga

SEQ ID NO: 40885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctggagctcagctttactatggtttaaa

SEQ ID NO: 40886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctggctatttttctcattcgaacgtcgc

SEQ ID NO: 40887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgtacggggtttggtagttgctgtcgc

SEQ ID NO: 40888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctgttcgcgaacagctcgggcgtgatcg

SEQ ID NO: 40889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccttcgtgggtaccggccaaggagtgtga

SEQ ID NO: 40890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccttctgtgcgcatgaacaatgtgggatg

SEQ ID NO: 40891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccttgactcaatcgcggaaagtatggatg

SEQ ID NO: 40892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaccttgcaattgaacaatgccacgtcatac

SEQ ID NO: 40893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacctttaaataactcagacttcgaccgtgt

SEQ ID NO: 40894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaacctattgattcagaccacggggagc

SEQ ID NO: 40895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaactggtcagggaacatcttgtatctc

SEQ ID NO: 40896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaagccctagtctgtcttagtctgctgc

SEQ ID NO: 40897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaaggtcgtgtagtattgaggttcggac

SEQ ID NO: 40898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaattgcgagctcgggaaaaggcaatcc

SEQ ID NO: 40899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaattgcttagcacatggtttcaggagt

SEQ ID NO: 40900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacacccaacatccattctccagtgcgg

SEQ ID NO: 40901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacagaagtaatggacgactgacaggta

SEQ ID NO: 40902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacagcagcttggactcgccgggaagtc

SEQ ID NO: 40903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacaggggatgaggggatgcgtctgaag

SEQ ID NO: 40904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgaccaacagacggatgcattgagcagtc

SEQ ID NO: 40905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacgcgagttgcgaggttatcgaacctc

SEQ ID NO: 40906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacgcgcagagattcgattattcgcggt

SEQ ID NO: 40907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgacggacacgttacggacatggatatcc

SEQ ID NO: 40908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgactacacttactgcttttcatttagtg

SEQ ID NO: 40909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgactcgatattggccaatcccaggtcct

SEQ ID NO: 40910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagaatctgatcgcgggttctaggtgga

SEQ ID NO: 40911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagacgtcggtggatccgagtgtggtcg

SEQ ID NO: 40912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagagagagcgggtgtgcagggcgaggg

SEQ ID NO: 40913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagccacacctgtcttatagggtcctgg

SEQ ID NO: 40914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagccgactctagtcgctactccttggc

SEQ ID NO: 40915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagtaattggtcggacgtttcattttgc

SEQ ID NO: 40916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagtgatcaagtttatcggggctgtgtt

SEQ ID NO: 40917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagtgtcgacgaccggccagactaggtg

SEQ ID NO: 40918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagttaaccagcaaatccctcgagttat

SEQ ID NO: 40919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgagttagcttgcagtggccactgggctg

SEQ ID NO: 40920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgatacaatcgaatgttaggccgtcgaga

SEQ ID NO: 40921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgatatcggaaccgtcgccccatctgcct

SEQ ID NO: 40922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgatccggcagtatcaaccagggtttggc

SEQ ID NO: 40923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgatcgctatacgctgacttgattgaccc

SEQ ID NO: 40924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgattaggtgtcggtggggttgccgggat

SEQ ID NO: 40925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgatttaggttctcattgctttcgttcgt

SEQ ID NO: 40926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcaacttgtgcacactgccagacatgat

SEQ ID NO: 40927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcaagacttgcgctggatttcggtgtga

SEQ ID NO: 40928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcaatgcccattaacagtgcgggggtag

SEQ ID NO: 40929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcacagtgtacgctcgggtcgcatgtcg

SEQ ID NO: 40930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcagacgtcgcggtaaatacgatgtggc

SEQ ID NO: 40931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcatcgtagcgaaccaggtgcacagggt

SEQ ID NO: 40932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccacgtatcctgtccagcggggtactc

SEQ ID NO: 40933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcccagctagtcctcgagtccacataat

SEQ ID NO: 40934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcccctatcgcgaaccatcaactgagta

SEQ ID NO: 40935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccctacgtctcggggccaatcccgttg

SEQ ID NO: 40936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccctggcccgtcgataggtggatcagg

SEQ ID NO: 40937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccgagactgtgctaatgtgcgttctgt

SEQ ID NO: 40938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccggatgagctaagtgacttggcggtg

SEQ ID NO: 40939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccggattctgtgagtacattcctgggc

SEQ ID NO: 40940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccggcaatacgctcgcaatcaggggcc

SEQ ID NO: 40941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccgggaaacagcgcacatcctagtgaa

SEQ ID NO: 40942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcctccacgtattgggttgctgcgtgat

SEQ ID NO: 40943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcctccaggtggcaactttgcggcccgt

SEQ ID NO: 40944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgccttgagctgtctagtcagtgagcggg

SEQ ID NO: 40945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgaaaacgtcgctcgggaacaatgtgt

SEQ ID NO: 40946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgaactctatccttatatgctgggtgt

SEQ ID NO: 40947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgaatttcgcgccccacggtttatgtg

SEQ ID NO: 40948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgattctaggagggcaaccgagtcgca

SEQ ID NO: 40949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgcacgccgggggagacgagtttagtg

SEQ ID NO: 40950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgcgcattcaggattttcacctacctg

SEQ ID NO: 40951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgcgtgttggtgctgggcatacccgaa

SEQ ID NO: 40952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcggcttgagtctgttggggagattggt

SEQ ID NO: 40953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcggcttgtgcgatggacagtcttcccc

SEQ ID NO: 40954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgggacaagaatgcatgggatagggtg

SEQ ID NO: 40955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgggcgatacgtgcggcgaacgcagaa

SEQ ID NO: 40956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgggctgccttcgcctaccactgtcgt

SEQ ID NO: 40957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcggggttttcgcctaacagcccgtcgg

SEQ ID NO: 40958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgtaactgcgagacggcttcgacggcg

SEQ ID NO: 40959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgtactgggctccggcaatttcagatg

SEQ ID NO: 40960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgtcggtcgtttaatacgtcatacccc

SEQ ID NO: 40961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgttgcgcagcaggataaggtgcgtct

SEQ ID NO: 40962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcgtttacgacgacaggtagactgatcg

SEQ ID NO: 40963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctaaggtacctcatgagccggtcattc

SEQ ID NO: 40964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctagtcacacatgtcagcgcctccggg

SEQ ID NO: 40965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctagtctacatgaacaggtttggtcca

SEQ ID NO: 40966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctcaaacgctctctgtgaggggtagcg

SEQ ID NO: 40967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctcagcaacctcgagcgagcggcatgg

SEQ ID NO: 40968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctcgaaaggtactctggaaccgagtgg

SEQ ID NO: 40969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctctgaactactcggcctcggggacac

SEQ ID NO: 40970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctgacgtgaaagccaaacgacctgtgg

SEQ ID NO: 40971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgctgcaccgttcgcaatcttatgcaccg

SEQ ID NO: 40972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgcttatcctctcacagttttgtgcgaat

SEQ ID NO: 40973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggaaaagcccttttgggttgtccatagc

SEQ ID NO: 40974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggaacatccaatatccgtcttgtacccg

SEQ ID NO: 40975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggaactatcgcgtctgttctggtgtagc

SEQ ID NO: 40976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggaagaccagatgcgatcaggtggcgat

SEQ ID NO: 40977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggaatcaagtctgcaaggatatcgggac

SEQ ID NO: 40978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggaccaaggggcgacacagcctagcatc

SEQ ID NO: 40979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggacgtacttcccctgatctgggcaccg

SEQ ID NO: 40980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggagtcggccgttgcaggttgcccctcg

SEQ ID NO: 40981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggatgtgaaacatcggaaacaataggct

SEQ ID NO: 40982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggattaatgagtccctcaactaaacacg

SEQ ID NO: 40983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcaaacgtgtttcaggtagcggctggg

SEQ ID NO: 40984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcacgagacgtatcttgcttcggtgca

SEQ ID NO: 40985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcatgtccgcaacaaagggcgcgacac

SEQ ID NO: 40986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcctaccttggaatgctcacgaccgag

SEQ ID NO: 40987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcgaacgtgtagggtgttgccaatgtg

SEQ ID NO: 40988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcgagtgtgagaattctgtactgactg

SEQ ID NO: 40989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcgcgccggagagagaatctggcgatc

SEQ ID NO: 40990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggcgtgttcattagatgacctgtgattg

SEQ ID NO: 40991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggctataggagtactggtccccggcgcg

SEQ ID NO: 40992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggctgtgtggctgacaaactagcctatg

SEQ ID NO: 40993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggaccatgtatacgcgcgatcccttcc

SEQ ID NO: 40994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggatccagcgtatgattcagagagttc

SEQ ID NO: 40995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggatcggcgaccatgtgtccttattgg

SEQ ID NO: 40996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggattatttacggttcttgctagctag

SEQ ID NO: 40997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggccctcgtaacaaagctgccgcatcg

SEQ ID NO: 40998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggctcgtgatcgcagtgaatgactccc

SEQ ID NO: 40999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggggcgctcaggtttgccgtccgcggag

SEQ ID NO: 41000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggggcggggtttctcttggttatcgggt

SEQ ID NO: 41001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggggctcacccagctctccgaagtactc

SEQ ID NO: 41002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggtaccatccatccacggtgcttcccc

SEQ ID NO: 41003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgggttccccgacgagaactgtatccggc

SEQ ID NO: 41004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtaagggacaaacataacagaactgac

SEQ ID NO: 41005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtatgggtcgtatgtggcaccttagca

SEQ ID NO: 41006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtcactggtcagctggaaggcatgagc

SEQ ID NO: 41007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtccgttggtcggttttggttgtcggc

SEQ ID NO: 41008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtcggaggttgcggatgaacatcttcg

SEQ ID NO: 41009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtctcttgtttagtccccatggctttt

SEQ ID NO: 41010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtctgcatctaatatgatggacgcggt

SEQ ID NO: 41011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtgacaacgatgaatcccccacgttgc

SEQ ID NO: 41012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtgacgcatcgcatgacagctccacac

SEQ ID NO: 41013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtgcgtactgaatcttctggtgccgac

SEQ ID NO: 41014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtggtgtcaaggtttcaatcggtgtgg

SEQ ID NO: 41015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtgtggttcagagtctcgtgttcgggc

SEQ ID NO: 41016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggtgtttttctggtgttgcgatgggcct

SEQ ID NO: 41017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttagttgccaggttgaattggtgcgg

SEQ ID NO: 41018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttcatccccacctctcaaacgcgaat

SEQ ID NO: 41019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttctgtctcgcgttgacattcggtcc

SEQ ID NO: 41020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttgcctcttccctcctacgtgcttgg

SEQ ID NO: 41021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttggcagctcaaactcattgtaccac

SEQ ID NO: 41022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttggggccttccacgcactgggagcc

SEQ ID NO: 41023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttgtctgtcttgatgcatgcactctg

SEQ ID NO: 41024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacggttgttttattgtccatatcaactgcg

SEQ ID NO: 41025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtaacacggctgaattattcatgcttta

SEQ ID NO: 41026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtaaggtaatgtgcgtccttcaggggtg

SEQ ID NO: 41027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtaatcgctcggtgcacgataccagctc

SEQ ID NO: 41028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtacaacaagtatctgcgagacgttctt

SEQ ID NO: 41029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtactgattgaccatgaccactgtctcc

SEQ ID NO: 41030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtaggcaagctctcgtaattcccagagc

SEQ ID NO: 41031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtaggttggtggttcaggtatagttgtt

SEQ ID NO: 41032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtataaagtgaacgagcgtatgctcttt

SEQ ID NO: 41033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtatgctctcagaggctggacgcagggg

SEQ ID NO: 41034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtatggaccttttatagccaaccgcacc

SEQ ID NO: 41035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtcacgaccccggttacgcttgtctcgg

SEQ ID NO: 41036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtcatatgctgttggttccacatatcga

SEQ ID NO: 41037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtcatcgcgagttgcacgtgtcgctact

SEQ ID NO: 41038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtccacacctatggcttctgttagagta

SEQ ID NO: 41039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtccctctggttttcctccgtattgggc

SEQ ID NO: 41040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtccttagtagagatgatataggcagat

SEQ ID NO: 41041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtcgagcggtctggacaaggtgttaggg

SEQ ID NO: 41042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtcgcgccttaccgccaacatgtctttg

SEQ ID NO: 41043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtcgcggcggaagggaactgtgcagaag

SEQ ID NO: 41044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgacctgacctccaacctcttcggagc

SEQ ID NO: 41045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgacgcattcccatgccgaaagcagcc

SEQ ID NO: 41046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgagtagttgctaagcccggcgtcatc

SEQ ID NO: 41047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgcgccaggctcttggatcattgttga

SEQ ID NO: 41048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgcgggcacataaaattggcaacttgg

SEQ ID NO: 41049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtggctggtcaaattgaaacttcttctg

SEQ ID NO: 41050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgggacatccgtttgttggtggcgtgg

SEQ ID NO: 41051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgggccggggttcacgctatgggccgc

SEQ ID NO: 41052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtggtccacttcctcctggagtctcgtc

SEQ ID NO: 41053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgtcatggatttgaggttccccatctt

SEQ ID NO: 41054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtgtgtcaggaggactcgaccggctgtg

SEQ ID NO: 41055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgttgcttcgttccggttagcagggccgc

SEQ ID NO: 41056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgttgttcgagtgttaattctgtgttgtc

SEQ ID NO: 41057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtttccaaagatgtgcatatcgttaaat

SEQ ID NO: 41058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtttcccattttgtcccttcctaggccg

SEQ ID NO: 41059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacgtttgaaatgttgcctctcgtgtgcagt

SEQ ID NO: 41060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaaagtattccgggcgacaatggggcgg

SEQ ID NO: 41061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaacagctggcaagcctccgagacaagg

SEQ ID NO: 41062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaacataccccggagcgggggtctaact

SEQ ID NO: 41063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaacgggttgaagaattagtgagtgcgc

SEQ ID NO: 41064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaacgtcattcaactaacggtcgtcttc

SEQ ID NO: 41065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaacttgtatctcccagggtatatcctg

SEQ ID NO: 41066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactaatgccgctcaatgaggtgatctgttt

SEQ ID NO: 41067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactactaagcctcgatacggcatggggtga

SEQ ID NO: 41068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactagcatcatgcagggacataacccggcg

SEQ ID NO: 41069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactagcatgctcgtcggaacgcgtcaccgg

SEQ ID NO: 41070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactagccgttggtacagcctctcagcggtt

SEQ ID NO: 41071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactagccttgttcccccaggttcttcttca

SEQ ID NO: 41072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactagtgctaaagggtcttcttactcgcca

SEQ ID NO: 41073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactatcaggcgtgcgctcagatgataatcg

SEQ ID NO: 41074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactatgacatttggaggtttggacatttgt

SEQ ID NO: 41075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactatgggctccacctatagcactctgcgc

SEQ ID NO: 41076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcaaacgatttccgcaaaacacctttcc

SEQ ID NO: 41077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcactctgttaattcttacccgcagcgt

SEQ ID NO: 41078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcatgagggttcgcgggacgcaacatgc

SEQ ID NO: 41079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactccaatgttcacatttttagtgctgttg

SEQ ID NO: 41080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactccgaggaaggtccgtcgtaagggaagt

SEQ ID NO: 41081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactccgggaatctccagccagtgcggtagg

SEQ ID NO: 41082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcgaagatcgtgcatgcagctctgtgtg

SEQ ID NO: 41083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcgagtcctcttccgtcgggtcctggtg

SEQ ID NO: 41084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcgccaccattggaatagactccgcatc

SEQ ID NO: 41085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcggaactacgcatcagacgcctccatg

SEQ ID NO: 41086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcggattgcggagagtgagaagtttacg

SEQ ID NO: 41087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcggcgtctattgctggaagtgcgccgt

SEQ ID NO: 41088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcgtgggtgccgcggtgtgatgaagcgt

SEQ ID NO: 41089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactctacggagaggatgggcttgtttccgc

SEQ ID NO: 41090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactctcagtgattttcgcacaatcccggat

SEQ ID NO: 41091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactctcctgacagtattttctttgctgtcg

SEQ ID NO: 41092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactctgacccgtccctagtaaaggtaatcg

SEQ ID NO: 41093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactctgggttcggtgttattccggtttgtg

SEQ ID NO: 41094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactctgttagttgtctattgctgcgttcta

SEQ ID NO: 41095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactcttttccctgtgcacgccgcgctttct

SEQ ID NO: 41096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgacacctttgagcgatgttactagtcc

SEQ ID NO: 41097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgactcacaatattgtatgcgctttgtt

SEQ ID NO: 41098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgatcgccaggtatcggtagtgcagatc

SEQ ID NO: 41099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgatttggtcccccctactctagaaata

SEQ ID NO: 41100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgcacatggctctagggccgcgaccggg

SEQ ID NO: 41101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgcagtctggaacttgtgactgtggcca

SEQ ID NO: 41102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgcatgactcaccgccgatgggttttaa

SEQ ID NO: 41103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgccttctcttcaagctgcttagggacg

SEQ ID NO: 41104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgcgcgcgattttcacaactggtctggg

SEQ ID NO: 41105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgcgggttcagtatgctagtcaaagtcg

SEQ ID NO: 41106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgcttctgggcgacataatgtctgctcg

SEQ ID NO: 41107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggagttaggggcggaatggtcattctg

SEQ ID NO: 41108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggagttggtgaactggtgttgaccggc

SEQ ID NO: 41109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggcacaatcctgttgcggacgatgtgg

SEQ ID NO: 41110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggcatgaaactgatccggcagaaatgt

SEQ ID NO: 41111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggcgcgctctgtcgacaaggaaggtag

SEQ ID NO: 41112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgggtaggctataccgggtagggggcat

SEQ ID NO: 41113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggtcgagtttccgtttggggtggttgc

SEQ ID NO: 41114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactggtctaacctggctacctggctggtcg

SEQ ID NO: 41115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgtagaccatagcatggagagtgcaagg

SEQ ID NO: 41116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgtattgctggatgcatcagtaggtcgt

SEQ ID NO: 41117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgtccacgctggtcccggattggtaatc

SEQ ID NO: 41118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgtcggtcggcaaggagtgacgtaccgt

SEQ ID NO: 41119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgtctgtaaagtagtgtttctctatcct

SEQ ID NO: 41120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgttcgatcccccgatggtttctttggg

SEQ ID NO: 41121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactgtttggtatttggaggactagcaacta

SEQ ID NO: 41122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttaaatttacggttgagacctcggccca

SEQ ID NO: 41123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttacgggcgttgatggtgtgttggcagg

SEQ ID NO: 41124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttagagggacttttggtagcaacagggt

SEQ ID NO: 41125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttagcggcaaaacagggcctggtggatc

SEQ ID NO: 41126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttatcgtaaccatctcaggtgctaacac

SEQ ID NO: 41127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttcaaaggtccgtgttttcactgtcgcc

SEQ ID NO: 41128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttcatcaggagacggtgatttaaagcgg

SEQ ID NO: 41129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttccgacggctatgtggacgcaacccac

SEQ ID NO: 41130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttcggactagccggaccttgtattttgg

SEQ ID NO: 41131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttctggtgtgcgggtgatttcaatgtct

SEQ ID NO: 41132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttgatgaagttgtaagtctatctcattg

SEQ ID NO: 41133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttgcgcctggctttggcgtgtttgcgca

SEQ ID NO: 41134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttggcaaacagagcggtatcaatacatc

SEQ ID NO: 41135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttggcggaagaggcaccgtctactagtt

SEQ ID NO: 41136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttgtccagatgcaactggggcatgacgg

SEQ ID NO: 41137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttgtcgaatttactgctgtccgtggctg

SEQ ID NO: 41138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttgtggtgagcatcataactgtacgcgg

SEQ ID NO: 41139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactttaacagtgttcatacgatcttgttac

SEQ ID NO: 41140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactttgtttcgcattctgtcactcgtcgcc

SEQ ID NO: 41141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcacttttagccataaacgcattagtaacttg

SEQ ID NO: 41142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcactttttccctgacgcgtgttccaaggtcc

SEQ ID NO: 41143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaacattagtccaggattgcatgatccc

SEQ ID NO: 41144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaacctctagaggcgacactttattctc

SEQ ID NO: 41145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaactttttcaggattcggtaaaattga

SEQ ID NO: 41146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaagcgcatcctgacgtgcttgttaacg

SEQ ID NO: 41147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaagcttgcaatgacaacgttcgataac

SEQ ID NO: 41148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaaggagaagacaagctgggcgcaaggt

SEQ ID NO: 41149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaataatatgaaaagtcctttggttgaa

SEQ ID NO: 41150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaatggaacttttagttgttcggtgacg

SEQ ID NO: 41151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaacacatttaagcgcagggctgatgtgg

SEQ ID NO: 41152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaccgggtcggcagaagcaggcaggctt

SEQ ID NO: 41153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaaggacgctaagacaagagcaatgacgc

SEQ ID NO: 41154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaataagcagaaaactaggaaaaacggat

SEQ ID NO: 41155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaatcgtggcggggagtgatcatgagcgc

SEQ ID NO: 41156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaatgtgtagactggaggcgtttgctctg

SEQ ID NO: 41157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaattaacgttctttgctcgtaagcttaa

SEQ ID NO: 41158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaattgcggcaaaggcgctgcgctcttgt

SEQ ID NO: 41159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacaataggtgtcccaaagaccaaagcgc

SEQ ID NO: 41160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacacgtcgcagggttgcacgtacagccg

SEQ ID NO: 41161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacacttttgactagtacgttcgagcggc

SEQ ID NO: 41162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaccgttcccgatgtgcgtagcgagacgt

SEQ ID NO: 41163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacctccctgacctcctctacaggctcgg

SEQ ID NO: 41164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacctctcgattctctgcatgcactcctg

SEQ ID NO: 41165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacgaggcaacgttcagttgggcatcttg

SEQ ID NO: 41166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacgcttgcagctatttagtagggacctg

SEQ ID NO: 41167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacgctttaaaatgacgaaacacgcgcgt

SEQ ID NO: 41168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacggattacgccccgcgcgtgccatagc

SEQ ID NO: 41169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacggtgcttccggcctgcgtcccttggc

SEQ ID NO: 41170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacggttacgtgactgtgggccagggggt

SEQ ID NO: 41171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacgtaccagtatcccccatactccaact

SEQ ID NO: 41172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacgtgaatacgggcatggctggggcttt

SEQ ID NO: 41173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagactaggaaggcataggggcttctcgtcc

SEQ ID NO: 41174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagactatctttggtaacttatcttgcttgg

SEQ ID NO: 41175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagactcgtcctactcgagtggcggaccggc

SEQ ID NO: 41176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagactgaagctgtgctttcgttaccagccg

SEQ ID NO: 41177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacttcaaccatgctctccacgggcgtgg

SEQ ID NO: 41178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagacttcgggcattagggggtttttcgttt

SEQ ID NO: 41179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagactttcggaacactcctgttaatacgtt

SEQ ID NO: 41180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagaaggcttggtgtcgggcgggggtaag

SEQ ID NO: 41181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagaatactgtgatgctactacgtaaaat

SEQ ID NO: 41182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagactgtcgacgcacccggaccttctgt

SEQ ID NO: 41183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagagttttgcagacagcggcccaggtcc

SEQ ID NO: 41184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcagaattgacgtttgaaaccacgcgg

SEQ ID NO: 41185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcagctggatctgggtgcatcaagtcg

SEQ ID NO: 41186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcctctcgatttcgggatgttcccttg

SEQ ID NO: 41187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcgatgaatggcggagatggtgcaatg

SEQ ID NO: 41188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcgcttctgcttttttgagggaacgtt

SEQ ID NO: 41189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcggactatttcactgtcgacgctgag

SEQ ID NO: 41190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcgtagctgtttggtacggttccgccg

SEQ ID NO: 41191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcgtgcggatgtgctcagcaatgggcg

SEQ ID NO: 41192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcgttcgtcttcgtaatacggtggacg

SEQ ID NO: 41193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcgtttgcgtaccggtaagtgttccaa

SEQ ID NO: 41194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagctcctaacaggtatcacgtcgcaggg

SEQ ID NO: 41195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagctctcattgattaccgtgtgtggctg

SEQ ID NO: 41196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagctgtcagcacgttgctttttagctcg

SEQ ID NO: 41197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagcttggattaaacgcacacaagcgcgc

SEQ ID NO: 41198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagaggctctgtacgtgcttcttctgtcggg

SEQ ID NO: 41199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagggcagttcgggataaaacaggttttc

SEQ ID NO: 41200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagggcctaaacgggcatggtgcgttagg

SEQ ID NO: 41201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagagtcgtttgatggggtagggacggaagg

SEQ ID NO: 41202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagatagtcgttgagtagcccggaccgcggc

SEQ ID NO: 41203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagatcccattgcacaaagtctgcattcggt

SEQ ID NO: 41204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagatgatagtaccgaagcggttgctgtttc

SEQ ID NO: 41205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagatgccagcttacgtcttgcgaactccgt

SEQ ID NO: 41206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagattaaatttcagccgtgggtttgtcctc

SEQ ID NO: 41207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagattcatcccgtttgtatgcaatggtgtg

SEQ ID NO: 41208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaacggacccggttagtacacaacccgc

SEQ ID NO: 41209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaactcaggtaccggacggagaggcagt

SEQ ID NO: 41210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaagagctcaatacaggacatgttgacc

SEQ ID NO: 41211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaagcaggtccgcttcagccgtgaccca

SEQ ID NO: 41212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaagggtatggggtgataagaggtgctg

SEQ ID NO: 41213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaatcgagattgatctaggcttttagtc

SEQ ID NO: 41214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcacacacttgtcgacgcccgattcatgc

SEQ ID NO: 41215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcacactaatggcgcgtggtctgaagagg

SEQ ID NO: 41216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcaccactccaaggtgggtaatagttgcg

SEQ ID NO: 41217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcacgagggcggacactattcctagctgg

SEQ ID NO: 41218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcacgccggacacacaagtggatagccgg

SEQ ID NO: 41219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcacgggacgatcgaatgcggtgtttccc

SEQ ID NO: 41220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcacggtacgacaaaagcttgcagtcctc

SEQ ID NO: 41221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcactagggccggtgccaaacttagatcc

SEQ ID NO: 41222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagaacgttcccctggcaagagtggacc

SEQ ID NO: 41223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagagcacgcttgtggagacgctcctct

SEQ ID NO: 41224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagagcgggtagaccgtcgggttcggct

SEQ ID NO: 41225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagcaggcctaaggctagacaagggccg

SEQ ID NO: 41226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagctgctgcgttatttcatagggtacg

SEQ ID NO: 41227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagggtgcaaatgaggatttctcggtga

SEQ ID NO: 41228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagtaaggtgtcgcaggcgtttctcgcc

SEQ ID NO: 41229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagtcacatgaagagatacggtcggggt

SEQ ID NO: 41230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagtgcccagcgagcgctacttgggaag

SEQ ID NO: 41231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcagttcgttatagttgtgatatactgta

SEQ ID NO: 41232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatagtcactacacccggggactaacgg

SEQ ID NO: 41233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatcgcagtggacgtgggctgtgctcga

SEQ ID NO: 41234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatcggctttcgacctccatctggtttt

SEQ ID NO: 41235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatcgtagtttgtggtcatggacgcccc

SEQ ID NO: 41236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatctccgcctcgcgaattgactgaagc

SEQ ID NO: 41237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcattgtttttcgccgtccatcgttctgg

SEQ ID NO: 41238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatttatggcacaccgtaacctacgcgt

SEQ ID NO: 41239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcatttgcgcgtttcatccgttggggccg

SEQ ID NO: 41240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccaacagtagccatctgtcgtctctcgg

SEQ ID NO: 41241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccaacgggcggcgaacagcatatggcct

SEQ ID NO: 41242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccaagacatgcgttacgactcttttatg

SEQ ID NO: 41243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccaagccttaggcccaacgctatgccca

SEQ ID NO: 41244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccacgactcattgccttattctagttgg

SEQ ID NO: 41245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccagcaaatctcgatatgtaccgttatg

SEQ ID NO: 41246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccagttgccggtcgtgccaaacaacgtt

SEQ ID NO: 41247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccatctcaagaggatttttgccacgagc

SEQ ID NO: 41248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccaattcttactaaatctggtgcgggg

SEQ ID NO: 41249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccacccacaagacactcgggttgtcga

SEQ ID NO: 41250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccagacgacgtgcacttgtgtgctctc

SEQ ID NO: 41251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccccgtggcctggaggtcaacttcaac

SEQ ID NO: 41252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccccgcggtcgtactcgtcgtcgcaatg

SEQ ID NO: 41253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccgattctgagaaggcggcgtttaccc

SEQ ID NO: 41254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccgcacggatgtgaggtcagctggtgt

SEQ ID NO: 41255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccggattggatctctggtgcatgcact

SEQ ID NO: 41256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcccggtggacgtcccctgtgatgcgcgg

SEQ ID NO: 41257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccctcacgaaccaaagcggtcggtggta

SEQ ID NO: 41258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccgaccgacggtggcattgccatacttg

SEQ ID NO: 41259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccggcggctttaggtgggtgctgggttc

SEQ ID NO: 41260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccgtcacgacgcggattcatgctcctgc

SEQ ID NO: 41261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccgtgtggagagggtacacgaccgcgag

SEQ ID NO: 41262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccgttcatggcttttaggagcacgcgcg

SEQ ID NO: 41263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagccgttgacgatgtgtgactaaacttgct

SEQ ID NO: 41264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctactaatgccacggtatatgtggagc

SEQ ID NO: 41265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctagcgtctcaaggctatgtacgctcg

SEQ ID NO: 41266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctcactgggcggacataggcactgttt

SEQ ID NO: 41267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctccaaacgctaagtcattcctgtgtc

SEQ ID NO: 41268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctccggcccttgcggcgtgattttggt

SEQ ID NO: 41269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctctagtcacgccccgctccaggcagg

SEQ ID NO: 41270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcctgtcagattctgttagacgttgactg

SEQ ID NO: 41271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgaaaacggccaccggtgcgtatattca

SEQ ID NO: 41272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgaacacggactctgggtgagtgggacg

SEQ ID NO: 41273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgaaggaaaccggacctcaacggctgtg

SEQ ID NO: 41274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgaagtggaggcgacgtccggtgtactc

SEQ ID NO: 41275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgacacctgttccgaaacgccggggacg

SEQ ID NO: 41276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgacgctttgatggtgtagcaaacacgt

SEQ ID NO: 41277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgataaatgtagagggctggcgatttag

SEQ ID NO: 41278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgatacaggaagcatcagagtagggcga

SEQ ID NO: 41279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgatctcgcctgtattgagacagatctt

SEQ ID NO: 41280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcaaagtgcctggacggcggataaatc

SEQ ID NO: 41281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcaccatgacaccggtaatcacttgta

SEQ ID NO: 41282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcaccgggtggaacgttcgctaacccc

SEQ ID NO: 41283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcagccccttcctgccgtaacggctct

SEQ ID NO: 41284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgccatacctcctcaacccttatgagat

SEQ ID NO: 41285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgccttacagggccctcttccacaactg

SEQ ID NO: 41286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcgagtcgaaccgtatgtccgtcacac

SEQ ID NO: 41287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcgggaagagaactgcaaacggatggg

SEQ ID NO: 41288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgcgggtgcacccgacatcatctaggcg

SEQ ID NO: 41289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggaccggggctatcatggcggtggtcg

SEQ ID NO: 41290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggagcgtgatcagtgtggaattgccgt

SEQ ID NO: 41291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggcatcgccaagtttcgtccggggctt

SEQ ID NO: 41292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggccatacgttatggggtttctggctg

SEQ ID NO: 41293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggcctgtgtacactttcggagttaaat

SEQ ID NO: 41294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggcgccgacagagaaacttgtaggcgg

SEQ ID NO: 41295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgggattcttgtgaaacctttgaccccg

SEQ ID NO: 41296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgggcaaagcagcggtgatgtcagcaca

SEQ ID NO: 41297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgggcagacattctacgggtgtcggggg

SEQ ID NO: 41298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgggtctcaactacgatccaggctcaag

SEQ ID NO: 41299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggtcaaacctcaatcgaaatgggaagg

SEQ ID NO: 41300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggtgaccatcgagggcagtccgctatg

SEQ ID NO: 41301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggtgatgtggttaagtcctttgtttgt

SEQ ID NO: 41302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcggttgctagggtccataagcttctggg

SEQ ID NO: 41303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgtacgtggcgcgtggggactacgattt

SEQ ID NO: 41304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgtcaagcgagtgtagattgccctttag

SEQ ID NO: 41305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgtccagttatgcagcaagcgaattcta

SEQ ID NO: 41306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgtgtagttgtgtttagttttactactc

SEQ ID NO: 41307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgtgttctagcgttcatcggccgtcggg

SEQ ID NO: 41308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgttaaagacagtactgggcaggccgtt

SEQ ID NO: 41309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgttggtgtaggcgataagggtgcggtg

SEQ ID NO: 41310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcgttgttggatggctccgaactcgcgac

SEQ ID NO: 41311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctacacatgtgcatgctcgtactgcgat

SEQ ID NO: 41312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctagacaatctggcgtgtgtaacgcagc

SEQ ID NO: 41313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctcaatgagtggggagttcggatcaaca

SEQ ID NO: 41314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctcaggtaacagtccaaagtgcggtatt

SEQ ID NO: 41315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctcccttagcgtgctcattacctaggat

SEQ ID NO: 41316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctccgggcctggtcgatcttgggggtgt

SEQ ID NO: 41317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctcgcgatcccttgtgcatgcatctgcc

SEQ ID NO: 41318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctcgctttccataggtgtccgaaaccat

SEQ ID NO: 41319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctctccactttaatcccggttcggccgt

SEQ ID NO: 41320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctctgggtggaacgatgccaacgaggcc

SEQ ID NO: 41321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctcttgcggaatccgaaatcgagcgtgg

SEQ ID NO: 41322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctctttgccgacgtcgagactcgcaccc

SEQ ID NO: 41323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgacaatggtcccacggccggactatt

SEQ ID NO: 41324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgaccgaatactgtacgatcggcccct

SEQ ID NO: 41325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgcccgtcagatattggtatgcgtcac

SEQ ID NO: 41326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgcttcttgtaactgtatccctctggt

SEQ ID NO: 41327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctggaagatagcaactcttcgacctggc

SEQ ID NO: 41328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgtaccgcagtacacgctactcagcgg

SEQ ID NO: 41329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgtagtacccgtatcaccactccaaga

SEQ ID NO: 41330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctgtttcgcaagcgccggcttcatatgt

SEQ ID NO: 41331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcttcggacatgcgcgcgacatgtaactt

SEQ ID NO: 41332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcttcgttctggttagtacagcgtaggag

SEQ ID NO: 41333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcttcttaagtccgtggtcaaagttgcac

SEQ ID NO: 41334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcttggctctctcgtggcctcttagaaag

SEQ ID NO: 41335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagctttctatagtattttcggtccaaaagt

SEQ ID NO: 41336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagcttttaggtctatagccttcggcgactg

SEQ ID NO: 41337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaaacgcgccctcctggtctgggcccgg

SEQ ID NO: 41338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaacttcgtctccgcctggctcacgcgt

SEQ ID NO: 41339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaacttctgccagtgttaccccgatttt

SEQ ID NO: 41340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaagcattacgcaaagtcgcttaaatcg

SEQ ID NO: 41341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaataaatcagcgtgggggtgggcgcgg

SEQ ID NO: 41342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaatgcaccgtgtagatcccgatccagt

SEQ ID NO: 41343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggacaatggcgccccgtcgagcggctgag

SEQ ID NO: 41344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggacacctaataggaaatggcctcattta

SEQ ID NO: 41345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggacattggagggggcttgtctgagcggc

SEQ ID NO: 41346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaccccggcagtaggagtaggtgccagt

SEQ ID NO: 41347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaccgagacatcgcccaaagtcactatc

SEQ ID NO: 41348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaccgggtccgattgtccgctacttgga

SEQ ID NO: 41349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggacgaggtgcgctctagtatgtgtccga

SEQ ID NO: 41350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggacggatggcggagtagcactcggtcgg

SEQ ID NO: 41351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggacgtggatctgcgggcctgactgggag

SEQ ID NO: 41352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggactttgttaggataatcggcttgctcc

SEQ ID NO: 41353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggagaaataaacccaaaaatcacgagcgg

SEQ ID NO: 41354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggagacgaccggcccggagtaacccatgc

SEQ ID NO: 41355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggagggcggatttcttgtgggggcacata

SEQ ID NO: 41356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggaggtgcgctccatatggattagtgcta

SEQ ID NO: 41357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggagtcattacggagctctcttggacacg

SEQ ID NO: 41358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggagtccggatgtacttactccgacgtag

SEQ ID NO: 41359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggagttcctcgaatccgcctttgagcagt

SEQ ID NO: 41360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatcagctgtgttgtgttctagccttgc

SEQ ID NO: 41361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatccaacaaacatttggacgttaaatg

SEQ ID NO: 41362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatcgtattgcagaagcactcatggatg

SEQ ID NO: 41363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatgcagcgtggcgtcgagggctttgcg

SEQ ID NO: 41364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatgcggtactagttgctttgtacctgc

SEQ ID NO: 41365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatgtacgtggacttgtcatcgatgtag

SEQ ID NO: 41366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatgtcttatgaaagacagttggttcat

SEQ ID NO: 41367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggattagtaccggcgggatctcctctatg

SEQ ID NO: 41368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggattcacagcgagcacgtcactcggccc

SEQ ID NO: 41369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggatttttacgttggtttctccagaagtg

SEQ ID NO: 41370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcaaaagtcagtgggagcgacctgaaca

SEQ ID NO: 41371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcaacagtacagctgccagggcggagtg

SEQ ID NO: 41372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcaacctcgtcgttcttactaggcacga

SEQ ID NO: 41373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcaaggacagcgataggacgatggcccg

SEQ ID NO: 41374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcaagggggggactttgtgcacgcttcg

SEQ ID NO: 41375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcacacgggggttatacggaccagtgtc

SEQ ID NO: 41376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcacagacgcactgggagtggcactagt

SEQ ID NO: 41377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcacttcccagagaatcgacctgcacat

SEQ ID NO: 41378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcactttcgtcgcttgcatgatatcggt

SEQ ID NO: 41379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcagagcaacaaggcccttggataggca

SEQ ID NO: 41380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcagatccattgtcatcaggggtgctgg

SEQ ID NO: 41381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcagcatgggacatgacgttaaccgggg

SEQ ID NO: 41382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcaggttagtcattagagttcgggtgct

SEQ ID NO: 41383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcagtaaaggggcggcaacgcggttgac

SEQ ID NO: 41384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcattgcagggactctagaatgcgccgg

SEQ ID NO: 41385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcatttaaggctaatcgagcagaactag

SEQ ID NO: 41386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccaacctagtaaaggtggtgaccagcc

SEQ ID NO: 41387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccaactgcaccctggtccccatcagcc

SEQ ID NO: 41388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccacaatgagggacgaggtgttcggtc

SEQ ID NO: 41389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccaccactctactctctgtagacaggg

SEQ ID NO: 41390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccacggtgtcggcgatcggcccggttt

SEQ ID NO: 41391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccatcgattggaactcacacgtggacg

SEQ ID NO: 41392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcccaggccgttggtatgcccaggtacg

SEQ ID NO: 41393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccccacggaaagatatcttgctccacg

SEQ ID NO: 41394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccctgttcgcttggacaacgtttatgt

SEQ ID NO: 41395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggccgtggaacattccattcatcgcttac

SEQ ID NO: 41396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcctgggcgaagtagtgttccggtggtt

SEQ ID NO: 41397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcctgttcgagctagttcctggggctat

SEQ ID NO: 41398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgaaatgactggtctcgcgaaagtagg

SEQ ID NO: 41399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgaacataaaactgttcatttctttgc

SEQ ID NO: 41400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgacggatcagcgacgtgcaacaggtg

SEQ ID NO: 41401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgagagccgcaccttggagactgtttt

SEQ ID NO: 41402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgcaggagtggacgggcatcgggaggg

SEQ ID NO: 41403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgcagggagaaatcggtagggtcgcgg

SEQ ID NO: 41404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgcgaatcttgacactcttggtcggtg

SEQ ID NO: 41405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgcgctgagaagcagtttgtttaggat

SEQ ID NO: 41406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcggggcccatagatctccagcttggtc

SEQ ID NO: 41407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcggtcggttcgtacccgcaatccctct

SEQ ID NO: 41408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgtaccgaagtctaggacataccctcc

SEQ ID NO: 41409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcgtcggtattccgtctagctgcattta

SEQ ID NO: 41410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctacgagccattccccacacatggacg

SEQ ID NO: 41411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctagatcggtggggatgagccctatct

SEQ ID NO: 41412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctataggtagtctcggtcggacccgtg

SEQ ID NO: 41413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctctcgtgctcattccagacaaccaca

SEQ ID NO: 41414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctgcaatcggctccgagttccagttcc

SEQ ID NO: 41415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctgccttccgcttgtgcatgcaggcgt

SEQ ID NO: 41416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctggcgcggctaatggcctttatggtg

SEQ ID NO: 41417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctggcggcaaggttaggcggggtcacg

SEQ ID NO: 41418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctgggaaggttgaacaatcgaaccgcg

SEQ ID NO: 41419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcttccggctggagggccacaatggtct

SEQ ID NO: 41420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcttcgaaaggtgagagggcacacgtcc

SEQ ID NO: 41421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggcttggtgggtcggtggttgtggggtgt

SEQ ID NO: 41422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctttcgctcggcgagttcccagctcta

SEQ ID NO: 41423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggctttgcgctgtgagtgccgcgcacgat

SEQ ID NO: 41424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggaaccccccattggcgccggcgtggtg

SEQ ID NO: 41425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggaagacacacattaaaggcgacagtcc

SEQ ID NO: 41426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggacaccccgttctggcacagtaggatg

SEQ ID NO: 41427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggacactccctccctagggggatatcgg

SEQ ID NO: 41428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggacgtggagggacctagcacaggtatc

SEQ ID NO: 41429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggaggtgcgcgggttatactacatatgt

SEQ ID NO: 41430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcacaataggaacacgagccggctcgg

SEQ ID NO: 41431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcagtgctcaccggcttccctttgcgg

SEQ ID NO: 41432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcagttagctgtacgcaaatgaatgta

SEQ ID NO: 41433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggccaaatcttggttgcgatcgtgtcgt

SEQ ID NO: 41434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggccaatccatcagccaggcgggggctt

SEQ ID NO: 41435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcctaagttgtccggagtacgagtcaa

SEQ ID NO: 41436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcgctttacttactaacttctagtgcc

SEQ ID NO: 41437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcgtggaagggccaaagttggaaggcg

SEQ ID NO: 41438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcgtgtccgtggctgtgatgtggtctg

SEQ ID NO: 41439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggctacctgaagtaaagcggggcggact

SEQ ID NO: 41440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggctggagaataatgttgcaggtgcgcg

SEQ ID NO: 41441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggcttcatagggatgcttccactcctgc

SEQ ID NO: 41442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggggcacggcgtgggtggtgagctgccct

SEQ ID NO: 41443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggggaggacattgcgcgaaggtgggttc

SEQ ID NO: 41444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggggcacgcgcgtcttattacgctgggc

SEQ ID NO: 41445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggggcggtgcgactagtgttggatcgat

SEQ ID NO: 41446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggggtaactttctgaagtttcgttttatg

SEQ ID NO: 41447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggggtctcgacgggagggcttagtcttac

SEQ ID NO: 41448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggggtgcgcggccaagcataaggtcaaag

SEQ ID NO: 41449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggggttattatagcctagatttcctatat

SEQ ID NO: 41450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggtatgaactttcaacacattgccatct

SEQ ID NO: 41451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggtctcattgtgggggattccaggaggg

SEQ ID NO: 41452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggtgggttttggcaccgtcgtgcgctga

SEQ ID NO: 41453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagggttggggggaaagctgcgccaaatgcg

SEQ ID NO: 41454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtaacccgataccttggggtagcatttg

SEQ ID NO: 41455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtaagagaagtggtcatgcttgagggtc

SEQ ID NO: 41456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtacgaaccgggtatgcttggcgcgtcg

SEQ ID NO: 41457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtacttggtcccgactgggcttctgaaa

SEQ ID NO: 41458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtagccggtatagtcctgtctttcgatg

SEQ ID NO: 41459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtatcattggtcatatcttagcacggtt

SEQ ID NO: 41460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtcatgggactagctccgttggggttct

SEQ ID NO: 41461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtccactcattcatatgtcggcagactg

SEQ ID NO: 41462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtccagtccgtttaacatccacccgcta

SEQ ID NO: 41463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtccgctcagtctcggtacgataccggg

SEQ ID NO: 41464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtcgcaagtgggatatctgttcttcgcc

SEQ ID NO: 41465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtctcgctggctagtttgcactacctct

SEQ ID NO: 41466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtctgacctcatcaaaacctagtattgc

SEQ ID NO: 41467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtgaagccgaaccgtgggcagaagcgag

SEQ ID NO: 41468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtggatgggagacggaggtcgagttcga

SEQ ID NO: 41469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtgtctacttccttacttgaacgaatga

SEQ ID NO: 41470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtgttcattcatgtcccccagggtgtga

SEQ ID NO: 41471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttaaggtgagcatactgatgactgatc

SEQ ID NO: 41472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttcaactgaacgtcgaaagaagtcggg

SEQ ID NO: 41473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttgcggactatttgcgactaatgaagc

SEQ ID NO: 41474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttgctattacttaaactctcctctaca

SEQ ID NO: 41475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttgctcgaccggccgctgatcggtgta

SEQ ID NO: 41476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttggaagagctctgctgcgttggctgg

SEQ ID NO: 41477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttggagtcagccatgtacgcgttgcgg

SEQ ID NO: 41478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggttgggacgatctcacacgtgtccacgc

SEQ ID NO: 41479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcaggtttcgtgctgcaatattggcacttccg

SEQ ID NO: 41480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaaacgtaaagcctgtaagtgtatgcac

SEQ ID NO: 41481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaaatcaatataggtgacggcgttagtc

SEQ ID NO: 41482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaacatagtcggcctccaaacgttcatc

SEQ ID NO: 41483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaagtttaagaaccgctgcggtcgtaat

SEQ ID NO: 41484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtacaagccacggtgtgcatgaatgttaa

SEQ ID NO: 41485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtacaagtagagttgctggctacggttcg

SEQ ID NO: 41486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtacaggagcagtttataatgcttgccgt

SEQ ID NO: 41487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaccacccagtggtcggcgttttggctt

SEQ ID NO: 41488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtagagactcggcaatcttaaagcgttcg

SEQ ID NO: 41489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtagcggtatgcccacgagaagcgtcatg

SEQ ID NO: 41490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtagcgtgcgtcgaaatcggcgtgattca

SEQ ID NO: 41491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaggcttatgtcacgtcggaactcaggt

SEQ ID NO: 41492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtaggggggctccactcaagttctttgtg

SEQ ID NO: 41493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtagttgacaggttcaggcgagtcgtttg

SEQ ID NO: 41494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtatcctcaacaacattccattcgatagc

SEQ ID NO: 41495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtatgtcgaggcacccttctggccgtgga

SEQ ID NO: 41496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtatttgtattcacggacactggtatggg

SEQ ID NO: 41497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtattttggcatttgtcatccgcattact

SEQ ID NO: 41498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcaaatggactcgggtgtaagggtcggg

SEQ ID NO: 41499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcaaggcgcaccgaaggcagtcatccgt

SEQ ID NO: 41500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcaggacgggtggcgctgaggctcgcgg

SEQ ID NO: 41501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcatgggcgaaggtgccggtgttagagt

SEQ ID NO: 41502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtccatggtttttatctctgctgagctcc

SEQ ID NO: 41503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtccgatggagggacacacgtttaccaca

SEQ ID NO: 41504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtccgtcgtaagccctctcaatggccggg

SEQ ID NO: 41505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcctagaaggtactgaatcgggggcttg

SEQ ID NO: 41506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcctgctttattaactagaggatcatga

SEQ ID NO: 41507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcgggagcctgtggattcaaccttcttg

SEQ ID NO: 41508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcggggcgtgcccgagcgtgttgactct

SEQ ID NO: 41509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcggtacgctataccgagaacggaggcc

SEQ ID NO: 41510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtcgtttagagggccatggtcatgctccg

SEQ ID NO: 41511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtctcccataaccaggcgagtaaccacgg

SEQ ID NO: 41512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtctcgcgggggtggtggtaggaagagtg

SEQ ID NO: 41513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtctggtggcgctccgctcccgatcaggc

SEQ ID NO: 41514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtctgtacggggcgtccactatacccttc

SEQ ID NO: 41515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtctttcaagtagggcattaagtgatcac

SEQ ID NO: 41516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgaaagacccaaagcggccgcgtgctat

SEQ ID NO: 41517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgacgtcaagagcgcgtggcggaactgg

SEQ ID NO: 41518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgagacagatagttgtggtgggctcagg

SEQ ID NO: 41519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgataaggactccacgttagctgtttgc

SEQ ID NO: 41520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgcaaaagcgtctggtttaggggcatcg

SEQ ID NO: 41521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgcaacgggcgtctggagctcatctgat

SEQ ID NO: 41522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgcaggagtcactaactcgtgccgcgcg

SEQ ID NO: 41523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgccatgacgctctgtctcttctcggct

SEQ ID NO: 41524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgcgaagctcaagcatgaacctgcaaca

SEQ ID NO: 41525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgctcacgatagccgtacgcgtatctgg

SEQ ID NO: 41526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggacgggtataacgtccatcggttggg

SEQ ID NO: 41527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggagatgatcgtgtggtgatttttgag

SEQ ID NO: 41528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggcggcggcttcgcttggataagcttg

SEQ ID NO: 41529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggctctcgcgccatattactgcttttg

SEQ ID NO: 41530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggctggccattgtcgtgcgaatactgg

SEQ ID NO: 41531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgggagatgcgccgaaatagggcgaacc

SEQ ID NO: 41532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgggcattcagttccgtaaccgccgtgg

SEQ ID NO: 41533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggtcagcgcgcgatatcagacgtaccg

SEQ ID NO: 41534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggtcggattaggcccggtaagtctcgt

SEQ ID NO: 41535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtggtggtcgacttcgggcatcggtggtg

SEQ ID NO: 41536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgtaaaggtcacgttttcagaaacgaat

SEQ ID NO: 41537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgtcaccgattgtaatcccgtacgagta

SEQ ID NO: 41538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgtcgggaagcgtccgccacgttgctgc

SEQ ID NO: 41539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgtctcaaaagagcttaagcgaatgtct

SEQ ID NO: 41540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgttagctctcacacgatcccggcgcct

SEQ ID NO: 41541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtgttcctctgagttcttttcagataatg

SEQ ID NO: 41542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttaacacttgcaaatttcgtatccaggg

SEQ ID NO: 41543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttaagtatgcctcactagtactccaggc

SEQ ID NO: 41544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttaatctttgtatcgcatgagggtgtct

SEQ ID NO: 41545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttacccacaccttggcgggctcaccttc

SEQ ID NO: 41546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttcaaggcgacaaatagacctctcccat

SEQ ID NO: 41547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgacgagcatttagacagctcatagcg

SEQ ID NO: 41548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgaggcttaatgttgcgctccgtgtca

SEQ ID NO: 41549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgaggtatgtgttacgtttagtccgga

SEQ ID NO: 41550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgataactcagctgttcagggtttggc

SEQ ID NO: 41551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgatcgtgtatttaaactacgctggtc

SEQ ID NO: 41552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgattcgggggaggtgtcgccaagttt

SEQ ID NO: 41553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgcgttatacctgtatacagcggtggg

SEQ ID NO: 41554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgcttgtggaggttaggagctcatcga

SEQ ID NO: 41555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgtgtctggaagagctctcgtcgtccc

SEQ ID NO: 41556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttgttgcaaagggtcatacaaacgcgcg

SEQ ID NO: 41557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagtttgccggtgtgcttcaaattgcagccg

SEQ ID NO: 41558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttttaacgcgtttgcgaagcttcagttg

SEQ ID NO: 41559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttttagcctcgtagtgccgaaggaggag

SEQ ID NO: 41560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcagttttctcagtagtcgttaaatgaacgta

SEQ ID NO: 41561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataaaccgcggcggtaacggcttcactgct

SEQ ID NO: 41562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataaatatgtggttggtaagtaatccgggg

SEQ ID NO: 41563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataacagtgcggcctgaaagggatatagtc

SEQ ID NO: 41564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataacccttcatcaacgtcgagggcgtgta

SEQ ID NO: 41565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataaccgtgggacacgctcattttcgacac

SEQ ID NO: 41566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataacggagctggataaatgacctccgctg

SEQ ID NO: 41567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataacgttgccgatccgttctttaggtttg

SEQ ID NO: 41568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataagagatcaggcgtaggcgtattcagtt

SEQ ID NO: 41569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataagggatcgggacaaaaggcgttcgtag

SEQ ID NO: 41570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataaggggcgtcttcctatacagcttcccg

SEQ ID NO: 41571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataagtcccgcaggtcgcgtatgatcagtg

SEQ ID NO: 41572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataagtcgcagtagtggtagcagccagccg

SEQ ID NO: 41573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataagtgatcgcgaacaacgggcgggcgtt

SEQ ID NO: 41574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataagtgtcgcctctttaacgggatgtaag

SEQ ID NO: 41575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataatcacaccgcccgtgctgtcccacagg

SEQ ID NO: 41576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataattagacgtacggtctgtaccacgtgg

SEQ ID NO: 41577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataatttttcctcgttttatgtgccgaggt

SEQ ID NO: 41578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacaaccgtcccttcgcccccgtaccgag

SEQ ID NO: 41579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacaacgcaagttcatctctttttaaatc

SEQ ID NO: 41580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacacatgcattcacgagcctggatgtgc

SEQ ID NO: 41581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacacctcggctcttacgcgttgtgcagg

SEQ ID NO: 41582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacagaatgatacaggattggcccgatcg

SEQ ID NO: 41583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacagtctggttattccgagatagtgcta

SEQ ID NO: 41584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacagtgttctcgatttgatttcgtcttc

SEQ ID NO: 41585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacatcccaattcatgtgaaacagtcggc

SEQ ID NO: 41586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataccattagtacaccgggcatgcatgtgt

SEQ ID NO: 41587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacccgggtaacaaggctgtgtcgaaggt

SEQ ID NO: 41588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacccttggggtgacgatttgctgtgttc

SEQ ID NO: 41589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataccgacctcactgagcgcgcaagtcctc

SEQ ID NO: 41590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataccgagtttaaggatacaagctccctcc

SEQ ID NO: 41591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataccgtcgcggcaggtttttgtaccagtt

SEQ ID NO: 41592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgaaggacatgtggcaatttgacatcg

SEQ ID NO: 41593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgacgccatatgacgagtggtactaag

SEQ ID NO: 41594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgcataacggattgtctaaccgtcgta

SEQ ID NO: 41595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgccgttggactactgggttgtgctac

SEQ ID NO: 41596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgcggcactaagcaaaatgcttcgacg

SEQ ID NO: 41597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgcgggtcctggagattggcgcgtcac

SEQ ID NO: 41598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgctaccgtaagaaagtgcatctctac

SEQ ID NO: 41599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgtcttgcgaaatttgttggggtcctc

SEQ ID NO: 41600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgtgtaagagcggttggggttaggtac

SEQ ID NO: 41601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacgtttgatggccaggcctcacgttacg

SEQ ID NO: 41602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatactaaggagggtctggctcacgagcctg

SEQ ID NO: 41603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacttatgtaggaaggtaatttctgtggt

SEQ ID NO: 41604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacttattacgccacgtcagcatcaagac

SEQ ID NO: 41605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatacttgaagtgtttgggcatccgatgggg

SEQ ID NO: 41606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagaagccacctggactcggttacaacgc

SEQ ID NO: 41607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagcacgaagacgggcggctctgtgctgg

SEQ ID NO: 41608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagcactaggtcacgtctaaaatctaatg

SEQ ID NO: 41609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagcaggttaggtgtctgcgtggggtact

SEQ ID NO: 41610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagcttttcatccgttggtcgcaagacat

SEQ ID NO: 41611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataggaagcggtcgcgcgcaagtatcgcgt

SEQ ID NO: 41612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataggagtcttaacgaataggcggactagg

SEQ ID NO: 41613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagggatgaatgtagacgtacaagagaag

SEQ ID NO: 41614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataggggaagtgttcgtggttgcgctttta

SEQ ID NO: 41615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcataggtcagtggtgcgcgttacttgccgta

SEQ ID NO: 41616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtacggaaagtgaggcgggtaggtggt

SEQ ID NO: 41617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtacggcccacactcccgccacgacgg

SEQ ID NO: 41618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtacttggttcagcacagagttgcatg

SEQ ID NO: 41619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtatgaccaatcctcggggtgctttca

SEQ ID NO: 41620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtggagagagtacactacgtttccaac

SEQ ID NO: 41621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtggtgtttttagtttcggacagcttt

SEQ ID NO: 41622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagtgtccgcgtttctgacgagggtgcgg

SEQ ID NO: 41623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatagttcacggcttatgcgcgagatttccc

SEQ ID NO: 41624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatatacaggtatccacatgctgagagga

SEQ ID NO: 41625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatattttcacaacatcctgacacaactc

SEQ ID NO: 41626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatgatggtttaggagttgttcgaggcga

SEQ ID NO: 41627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatgcacctgcgcgagagtgtgttgttcc

SEQ ID NO: 41628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatgctagtaagagcgtgatctggatgtg

SEQ ID NO: 41629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatgggtcactcctcatatagcaggcttg

SEQ ID NO: 41630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatgtgtgggagtgacgacgtatgctcga

SEQ ID NO: 41631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatattcaaagccgatggacgggtctttgtg

SEQ ID NO: 41632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatttccaatttccggggcctaagaagag

SEQ ID NO: 41633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatttccattctgttaagctttagtttcc

SEQ ID NO: 41634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatatttctccaacggaccttctaacgggtg

SEQ ID NO: 41635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatattttctcagtgtcgattgcgtgcttat

SEQ ID NO: 41636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcaaatgatcacatactcgacaagtttca

SEQ ID NO: 41637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcaacactggtaattagcgagcagcataa

SEQ ID NO: 41638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcaacagcaacaggtagcgagaagctggt

SEQ ID NO: 41639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcaactgggcacgggttcggggctcggat

SEQ ID NO: 41640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcaatgactctatgctggctgtctctgcg

SEQ ID NO: 41641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcacaagtccaatgatagcttcctcacca

SEQ ID NO: 41642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcacctccagagatgtctcaagttttcta

SEQ ID NO: 41643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcacgaacgccgcccagccgttacttatg

SEQ ID NO: 41644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcacggcaacgggcaaccctgaagaggcg

SEQ ID NO: 41645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcacgtcctcgacaggtctgatcctggaa

SEQ ID NO: 41646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcactcggcctaagccagtcatcgcctgt

SEQ ID NO: 41647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcactggcgagaagctaacggaattgcgt

SEQ ID NO: 41648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcagccgcaggatctcgtcgcaccgttag

SEQ ID NO: 41649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcagcgtgcactgtgagagcgatggtgcg

SEQ ID NO: 41650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcagctcgtcatgttctgtgaggccggat

SEQ ID NO: 41651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcaggactccggagctccgtcacacagtc

SEQ ID NO: 41652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcataggcagcctggcccgaacgagagcg

SEQ ID NO: 41653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcatcacacaccgggtgccacgcctgagg

SEQ ID NO: 41654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcatgacacatggatttccgtgacaccgc

SEQ ID NO: 41655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcatgtataccggtacacctggtaatgta

SEQ ID NO: 41656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcattatacgggcgaatgggtgccgcgtg

SEQ ID NO: 41657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcattgattattagcgacacatccgcgtt

SEQ ID NO: 41658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcattgtagccccgtactcttggttattt

SEQ ID NO: 41659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccaagggagtacgtcaaacactaactct

SEQ ID NO: 41660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccacgagggctatttcccggcgtcaacg

SEQ ID NO: 41661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccagacttaacattatcaactcgtatta

SEQ ID NO: 41662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccatagcgtattgatttgcgctcctcgc

SEQ ID NO: 41663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccatatctgggatcttcctgtgaggtta

SEQ ID NO: 41664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccatcggccacttcttggtgcctgcttc

SEQ ID NO: 41665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccccaattcactgatctggtaggggtca

SEQ ID NO: 41666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccccgttcagcgcggctctgttccacac

SEQ ID NO: 41667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcccggagccgtagccctcactcccgcaa

SEQ ID NO: 41668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccctcgcagttttaccacgcttacaata

SEQ ID NO: 41669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccctgactacagcgtgcgaaaatagggg

SEQ ID NO: 41670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccgaaaagtttcagtatcgagcgcataa

SEQ ID NO: 41671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccgacccgagtgtggactttgttacgcc

SEQ ID NO: 41672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccgatctctagggacgcgcaatctcttt

SEQ ID NO: 41673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccgccgcacctgatccgtccactcctgc

SEQ ID NO: 41674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccggaaacaagtttgggagtgttatcga

SEQ ID NO: 41675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccgtcgtaaacgcggtggtgtggggcga

SEQ ID NO: 41676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccgtgttccttggcgatccatccgcggg

SEQ ID NO: 41677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcctaatcttggtgtattgatcaacgcgt

SEQ ID NO: 41678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcctatttgcagtactgactttttcattc

SEQ ID NO: 41679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcctcggtttaataaagaatactcgtatt

SEQ ID NO: 41680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcctgtgaattgttggtggccaacagggg

SEQ ID NO: 41681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatccttggtgggtagaatgtggtacatcga

SEQ ID NO: 41682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcctttaacgtgtccactttgacaaactg

SEQ ID NO: 41683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgacagcttttcaatgatttctagaacg

SEQ ID NO: 41684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgacgcggcaagtaacggacagcacggg

SEQ ID NO: 41685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgacggagttgtttaagtgttcttgacg

SEQ ID NO: 41686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgactacgaggggctatcgggtgccgcc

SEQ ID NO: 41687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgagctgcggaagttcgccgtggattgc

SEQ ID NO: 41688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgaggggtcaggaatgcggcggcggctg

SEQ ID NO: 41689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgatgcgtccccgcggcggccagccgat

SEQ ID NO: 41690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgatttgccaaacacctcgggccaccaa

SEQ ID NO: 41691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgcaagcacccagagccgaggcgtcagt

SEQ ID NO: 41692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgccctcgatctcggtgctcaatgcgtg

SEQ ID NO: 41693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgcggacacgataggcgcgttcgcatgg

SEQ ID NO: 41694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgcgtgcataaaaccctttagaacgacc

SEQ ID NO: 41695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcggcgatgtattccaccttataacttcc

SEQ ID NO: 41696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgggattggatctattatctggtctgtt

SEQ ID NO: 41697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcggtaacgggttcgtagcttctgcgccg

SEQ ID NO: 41698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtattctgcgtggcttcccaacgggtg

SEQ ID NO: 41699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtccaagctatacggctaaggcccgcc

SEQ ID NO: 41700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtctggcttcctgggctatctttgtgt

SEQ ID NO: 41701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtgcaactcctcgacctccggatccga

SEQ ID NO: 41702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtgcaatcgggtcctttggggggagcc

SEQ ID NO: 41703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtgcgctggctcgtccgacactttatt

SEQ ID NO: 41704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtgctccataagggctttttgtacacc

SEQ ID NO: 41705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtggctttggcagtgcagtgtgggact

SEQ ID NO: 41706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgtgtgtttactctcaggccggtgggat

SEQ ID NO: 41707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgttcatggcattaacatatataagccg

SEQ ID NO: 41708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgttgctattggctcgacggtctacttc

SEQ ID NO: 41709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcgttggtccaagcataacctgcgaccaa

SEQ ID NO: 41710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctaacaagtgctcgtcaagggccccggt

SEQ ID NO: 41711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctacctatacgagccaacgcttgctgcg

SEQ ID NO: 41712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctagcatccactggtcatctatctgttc

SEQ ID NO: 41713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctagtcgcacagttatctaatgcgagag

SEQ ID NO: 41714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctatgtgcggctgtcggaccgggagtgg

SEQ ID NO: 41715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctattcccgagcgtccgaatttccccgc

SEQ ID NO: 41716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctcaatttacaaggatcatacaatgggc

SEQ ID NO: 41717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctcataggaacggcaatctcgagtatgc

SEQ ID NO: 41718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctcatgcttgcattatatacgtcgtgct

SEQ ID NO: 41719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctccaccagctcggccgcgtgaccaagt

SEQ ID NO: 41720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctccggatcagtctcgcggtgtcaagcg

SEQ ID NO: 41721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctcgagggctgttggtctttcaggtatg

SEQ ID NO: 41722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctcggactcggcaccagtcgacctttga

SEQ ID NO: 41723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctctacgggcaaatttgggctaatctat

SEQ ID NO: 41724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctctggctgcggggcaatatgccaggtg

SEQ ID NO: 41725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctctggggacacacggcatcagcacccc

SEQ ID NO: 41726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgaagatggcaggtcgctaaagagtgg

SEQ ID NO: 41727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgaccggtggttgcatactaatggcgt

SEQ ID NO: 41728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgactgtgtattaacaatgcggggaga

SEQ ID NO: 41729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgcaaacagcgtccagtctgcaaccac

SEQ ID NO: 41730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctggcaagtctggtcaatgactcaccga

SEQ ID NO: 41731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctggggctagtcgtcactctacatggcg

SEQ ID NO: 41732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgggggcgctagcgtccaattctgttt

SEQ ID NO: 41733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgggtcaggtgcatcgctcttcacttg

SEQ ID NO: 41734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatctgtatagctgcgaaccgatccgcctgg

SEQ ID NO: 41735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcttcctttggcaatagggccacaatctt

SEQ ID NO: 41736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatcttgtatatgtagttttcggataaacgt

SEQ ID NO: 41737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaaagtggcgcgggtgcacttgcaggtg

SEQ ID NO: 41738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaaccgtaaaggtttgcacgagtgactg

SEQ ID NO: 41739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaactgcgtatagcgatcgtcttttttg

SEQ ID NO: 41740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaagaaagtcgactgcaatggtttaagg

SEQ ID NO: 41741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaagagccccatcaatcgcgactataag

SEQ ID NO: 41742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaagcagaggtggttctcagtttcttgg

SEQ ID NO: 41743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaaggaacgccgattgcggcatggcgcc

SEQ ID NO: 41744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaatttgagacggctgtaagtgggatgg

SEQ ID NO: 41745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgacacaacggcattaactgcaggtttgc

SEQ ID NO: 41746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaccagcgcagcaagacagctttctctc

SEQ ID NO: 41747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgacccacactttcggcatgcttccggtt

SEQ ID NO: 41748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaccgaatagttgtcgtggtaaccgata

SEQ ID NO: 41749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgacctcaggtgtcataggcgtacgattg

SEQ ID NO: 41750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgacggcgtcaacggtttgtttcttaagc

SEQ ID NO: 41751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgacggctcctgcgctgccatgtgttcta

SEQ ID NO: 41752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgacgtcctgcgacactggtgcatctcgg

SEQ ID NO: 41753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagaagtgctaagattcgtattggccca

SEQ ID NO: 41754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagagtttgcgaggcgccaggcgggaag

SEQ ID NO: 41755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagcagtaagccaagtcaaccaaccata

SEQ ID NO: 41756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaggacacgcatagacggtaattgggtg

SEQ ID NO: 41757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgaggggaagtggtagaggcggcacctat

SEQ ID NO: 41758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagggtgagctgtacgttcccgatattc

SEQ ID NO: 41759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagtccacttcgcaacggaacccgcgcc

SEQ ID NO: 41760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagtgatcgtattcgcgccgtggggatc

SEQ ID NO: 41761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgagtgccgttagcgacaagcaaggacgg

SEQ ID NO: 41762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgataaggacgattaccaggttttgctca

SEQ ID NO: 41763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgatacatcatacgctactgccttttctt

SEQ ID NO: 41764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgatacattcggttcacagcggctgtacc

SEQ ID NO: 41765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgataggttcttcctggatttgtggaaca

SEQ ID NO: 41766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgattcgagctccggtgtgacaccagatg

SEQ ID NO: 41767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgatttgtacgggtctcgcctttctgacg

SEQ ID NO: 41768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaaactcacttttatttcgttcgttca

SEQ ID NO: 41769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaacggaccaaactaggtagcatcgtt

SEQ ID NO: 41770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaactcggtgtgccggtgagggggctc

SEQ ID NO: 41771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaagattcgttagtgctttgcgtgtgc

SEQ ID NO: 41772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaagctacggatagtaccacgtttggt

SEQ ID NO: 41773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaaggacgtcgtacctggtttccggaa

SEQ ID NO: 41774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaccgatcccgcacactcacgccgaca

SEQ ID NO: 41775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcaccgctacagtcgatctcggcccttc

SEQ ID NO: 41776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcacctgaaacattatggcttcgaatta

SEQ ID NO: 41777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcacgggtatcatagcactcattctact

SEQ ID NO: 41778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcacgtaggtctcggctcggctggtgct

SEQ ID NO: 41779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcagactaaccgcgagctcagtatgtgc

SEQ ID NO: 41780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcagtcgtgtggttgtttgcagctgctg

SEQ ID NO: 41781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcagtctacgtgggctggtgttgttcgc

SEQ ID NO: 41782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcatcgtttgggaacgggagtctgtgtg

SEQ ID NO: 41783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgccaatccatctagatgcctgcgtttcg

SEQ ID NO: 41784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgccactctaggttcatgtttgtgccact

SEQ ID NO: 41785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgccgcttaaggattggatggttttacga

SEQ ID NO: 41786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcctcttttccagcttaaccattgatca

SEQ ID NO: 41787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcctgtagagagcgcgctaccgtgatcg

SEQ ID NO: 41788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgccttcacacgcgagcggcagaccgcta

SEQ ID NO: 41789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgaaaggagtgcgtcacaactccgaaa

SEQ ID NO: 41790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgaaagtcgggtatatgacatcttaat

SEQ ID NO: 41791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgaaggatccagtcggtgtggcatcca

SEQ ID NO: 41792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgagaatgcgagtttacattcgggagg

SEQ ID NO: 41793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgaggttctggtatgccatgattacgt

SEQ ID NO: 41794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgagttactgtggagtcctagttgcat

SEQ ID NO: 41795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgcagtacgattatcctctggactctc

SEQ ID NO: 41796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgcagtcaaccgatgagggttaacggg

SEQ ID NO: 41797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgctcggcagggcacctccgttcgttg

SEQ ID NO: 41798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcggattattgggcaagcacgctcgcat

SEQ ID NO: 41799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcggcacactgaaaatttataccggatg

SEQ ID NO: 41800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcggcgaagagagtcacgatagtcggga

SEQ ID NO: 41801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcggggaggttagttggttctgtggtag

SEQ ID NO: 41802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgtaaggaagctttattgctctagaca

SEQ ID NO: 41803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgtagttaggcagctgtgcgaagagct

SEQ ID NO: 41804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgcgtctgtgccttgacgtgctttcccga

SEQ ID NO: 41805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctacacgttataacaagcatcgaggtc

SEQ ID NO: 41806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctaccacggggcgaacctctcagaggc

SEQ ID NO: 41807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctacccctggacggtcgctcccgctgg

SEQ ID NO: 41808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctatttgcagagtttacagccgtgctg

SEQ ID NO: 41809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctcagcgtgttaaccattttcttttgt

SEQ ID NO: 41810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctcctcccaacgggctttatcggaatg

SEQ ID NO: 41811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctctactttagacgtcggtagcaccct

SEQ ID NO: 41812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgctggtttgcatcgctttacgccttcgc

SEQ ID NO: 41813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggaattcagcctctcctgcgttgatgag

SEQ ID NO: 41814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggacggaccacacacgcacgtatttcct

SEQ ID NO: 41815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggagttacgaccggcatctgcatatagc

SEQ ID NO: 41816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggcatcagtcgctcgtacgggcagggac

SEQ ID NO: 41817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggcatctgctaaggtaagggcagcacgc

SEQ ID NO: 41818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggccattggcttacagtggaaggccccg

SEQ ID NO: 41819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggcctaagctgcgccagcatggcacgga

SEQ ID NO: 41820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggcctcagcgaacccggccgtatgacgg

SEQ ID NO: 41821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggcgcacaatctgggtctgctttggcat

SEQ ID NO: 41822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggcgtacgatgcacgctcagggcacaac

SEQ ID NO: 41823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggctactcttgttcaaccatcatgagag

SEQ ID NO: 41824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggctcgtcccgactcatcgtgtagtccc

SEQ ID NO: 41825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggctgtaaggacatggacttcagctagc

SEQ ID NO: 41826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggaattgactaggggctgcggggaagc

SEQ ID NO: 41827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggacggttcaagcagaaactcatagca

SEQ ID NO: 41828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggagctaggtaggcgtaacggcagtac

SEQ ID NO: 41829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggagtagttcttagtctaacggtcgcg

SEQ ID NO: 41830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggcgaatttagcatagactgttgaccc

SEQ ID NO: 41831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggcggggcgcggacgtagttaaagggt

SEQ ID NO: 41832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggctggcgttgcgcgcaaattaacttg

SEQ ID NO: 41833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggctgggtagcctttggggccggtatg

SEQ ID NO: 41834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggggccttcacagtcagaccggtaggc

SEQ ID NO: 41835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggggtactactacggtggccatcctcgc

SEQ ID NO: 41836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggggtgctgtgggaccggtttgggggtg

SEQ ID NO: 41837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggtacactggctgcctggtcgttgtct

SEQ ID NO: 41838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggttgctcttagtaactaccttggggg

SEQ ID NO: 41839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggtttaaaggtcgcagctctcgcccgg

SEQ ID NO: 41840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgggtttaagaatgcgacataacagtaga

SEQ ID NO: 41841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtcacatcaagcaggaacccagtggca

SEQ ID NO: 41842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtcagtgtcggactcaaaggtgggcac

SEQ ID NO: 41843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtcagttcctccccccgcgagaccccg

SEQ ID NO: 41844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtgatacgagccgttggcatctgtaag

SEQ ID NO: 41845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtgcgcgatttgatgtggcgccacgtg

SEQ ID NO: 41846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtggcggctggtcggcgatgagtcctg

SEQ ID NO: 41847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatggtttgtaactcggtacgcagcgaacgg

SEQ ID NO: 41848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtaaagtcgtcgcgcatgaacgtttgcg

SEQ ID NO: 41849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtaaggcgacttgttcagctgactggtt

SEQ ID NO: 41850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtaccacccaaaacctgagctaatccct

SEQ ID NO: 41851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtacggagcgagtattgatgtcaagtag

SEQ ID NO: 41852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtactccgtcccctacaagtcaggatac

SEQ ID NO: 41853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtcaaaatcacagtaaacctgcgccatc

SEQ ID NO: 41854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtcggtgcatctgggccttgtggcatga

SEQ ID NO: 41855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgactttatggttatttcatagctata

SEQ ID NO: 41856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgcaaatggggcggattcctcgctcga

SEQ ID NO: 41857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgccggttttaatactcagttcggctg

SEQ ID NO: 41858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgctcgtgttgccagaagatgcagtca

SEQ ID NO: 41859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgggctgtgtcgacatcgcgagcccgt

SEQ ID NO: 41860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtggttgcggccgtaattgtccggcttt

SEQ ID NO: 41861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgtcacttcgtcgttggcggtctgcgg

SEQ ID NO: 41862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgtgtcttgcgacctcaaggcaatgcgtc

SEQ ID NO: 41863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgttaagttgggagcgtcttacattcggc

SEQ ID NO: 41864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgttaggcaaggtatccgaactacttttc

SEQ ID NO: 41865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgttcgcggccagcagtcccggttctcta

SEQ ID NO: 41866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgttggtgtacacgttaaatacgaaccgg

SEQ ID NO: 41867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatgttttgttgcgtttccaagtgatctcgg

SEQ ID NO: 41868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattaacacctaggagcgggtcattcgggcg

SEQ ID NO: 41869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattaagcgcgtgctcgatccgtgcatcacg

SEQ ID NO: 41870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattaaggcgaacggtatcgaactcagagcg

SEQ ID NO: 41871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattacacactcacagagtcctatcctatat

SEQ ID NO: 41872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattaccgcgttcccatatcagtattgcgta

SEQ ID NO: 41873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattacggggggtggagatccatgccggaaa

SEQ ID NO: 41874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattacgtcttccgggccgtaccatcgcgcc

SEQ ID NO: 41875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattacgtgtttgccccgagctgtgtgtgcg

SEQ ID NO: 41876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattactgctcatcagttcagtagttgtagc

SEQ ID NO: 41877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattagcgtattactcggagccacagaaagc

SEQ ID NO: 41878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattagctgttagccatcactgttagattag

SEQ ID NO: 41879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattaggcattttggctgactatcgtcagtc

SEQ ID NO: 41880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattagtccgtttaggcgtttcgggagtact

SEQ ID NO: 41881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattagtcggcgaacgtcttctgaccacggg

SEQ ID NO: 41882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattagttatacatcgagtgaacgtgttggc

SEQ ID NO: 41883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattataaccatacatactcacgaccactaa

SEQ ID NO: 41884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattatagatagcgttcataggattaaactc

SEQ ID NO: 41885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattatatgtttatgtgggatacgcgacggg

SEQ ID NO: 41886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattatcgcggaaggttcagacaccgcttaa

SEQ ID NO: 41887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattatcggggcatacccgacggcaaaaccg

SEQ ID NO: 41888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattatcgtgactcactctgaggactaaggt

SEQ ID NO: 41889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattatctacaccttcccttgtaatagtttg

SEQ ID NO: 41890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattattcaaattatatttgtctcaggtccc

SEQ ID NO: 41891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattattcccggccagctttgactgacctac

SEQ ID NO: 41892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcaagaggagaccactcccgatgtcctc

SEQ ID NO: 41893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcacacattaatgtagtagagcgagcgg

SEQ ID NO: 41894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcaccctgtgataggccttaacgcaacg

SEQ ID NO: 41895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcaccgtccgagtcttatgggccgtgca

SEQ ID NO: 41896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcactcagtaatccgttcaatcacgcac

SEQ ID NO: 41897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcaggtgtgtcagcatgtgccagtagtc

SEQ ID NO: 41898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcattatgcgtgctgcctggcatatgtg

SEQ ID NO: 41899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcattttctgcctttttctctatatgtg

SEQ ID NO: 41900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattccatacagattaccgttggacccgcgt

SEQ ID NO: 41901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcccaggcgcgggtcgtgtacggtagct

SEQ ID NO: 41902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcccccgggttatacagcggtcttcgtt

SEQ ID NO: 41903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattccgcgcgtgtaagtttctgcaaggttc

SEQ ID NO: 41904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattccgcgtgggatagactgaagtgttggc

SEQ ID NO: 41905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattccgggtccaacggcttcacttgtacat

SEQ ID NO: 41906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcgaacggccttttcgtttgattcaccc

SEQ ID NO: 41907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcggcagcgaagccgtttgaatcgtctc

SEQ ID NO: 41908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcggtattgcatacagcgcagatctcca

SEQ ID NO: 41909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcgtggggttatcatggtcaactggtgg

SEQ ID NO: 41910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattctacgtgtgcgatatgcggaattcgcc

SEQ ID NO: 41911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattctaggtgatgaaggtcaacttactata

SEQ ID NO: 41912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattctctggtctccagctacttcaacgctt

SEQ ID NO: 41913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattctgctgcgccgtgccagtcctttacct

SEQ ID NO: 41914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcttatacgattttacacgtcacggttg

SEQ ID NO: 41915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattcttatgttacctacgtgttttcagagg

SEQ ID NO: 41916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattctttatattgatccgcaagttccccga

SEQ ID NO: 41917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgaaggactggaaggccaatccggctat

SEQ ID NO: 41918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgacggattggcttgcactcgatcttcg

SEQ ID NO: 41919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgatgcgaccggcactagaggatctcgg

SEQ ID NO: 41920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgcaccgagcaggcagattgaatgtgtg

SEQ ID NO: 41921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgcagagtgacaagactagtgtcagcgg

SEQ ID NO: 41922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgcctgttgaacgtgctctcacagggca

SEQ ID NO: 41923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgcgggtgtttctaatttaattggtcca

SEQ ID NO: 41924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgcgttgtgaggtacggagcggccgtgt

SEQ ID NO: 41925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgctatcatgtcagtgtgcgcgacggcg

SEQ ID NO: 41926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgctcggcagaactgggtcgcaggccat

SEQ ID NO: 41927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattggaagagtaggcaggttgaggacagat

SEQ ID NO: 41928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattggccaatgatttacgcgccaggctcca

SEQ ID NO: 41929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgggaacgcacatgtcgctctcggatct

SEQ ID NO: 41930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattggggctaatcggggcgaatgcaaggca

SEQ ID NO: 41931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgggtacacacacctgtcccgcgtggag

SEQ ID NO: 41932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgggtatcatagccacagtcaaaggcgg

SEQ ID NO: 41933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattggtcggtttgcactctttttcgatccc

SEQ ID NO: 41934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattggtttgacgcagagcggcggtgcaagg

SEQ ID NO: 41935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgtgcctagagaagggcatgtcttagtt

SEQ ID NO: 41936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattgttaaatgcgtaacggtttcggctgta

SEQ ID NO: 41937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttaagaggaattaccgtatgagtttcta

SEQ ID NO: 41938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttaatatccatcccacttgactgtgcaa

SEQ ID NO: 41939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttaggaggccaccacaagtaccccgcaa

SEQ ID NO: 41940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttccacaagaaagaggtcctttttgggt

SEQ ID NO: 41941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttcgtcccgcctaatgactatatctcca

SEQ ID NO: 41942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttcgtcggagcaaatcttaccagcgcgc

SEQ ID NO: 41943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttcgttagcgattcctctgatccgtgcg

SEQ ID NO: 41944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttctcagcgcgcgccacgggtatctccc

SEQ ID NO: 41945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttctcctctaccttttgtttgtccccgg

SEQ ID NO: 41946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttgatcatctgggcgggagcgggtgtct

SEQ ID NO: 41947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttggagactgcggaatagcgaacattag

SEQ ID NO: 41948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttgggtagcctgggcgagagacaggaat

SEQ ID NO: 41949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttgggtgttagggattggaggccggcga

SEQ ID NO: 41950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttgtagatacttactttttgacacgctc

SEQ ID NO: 41951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttgtgacgcgcattaggggcattttacg

SEQ ID NO: 41952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttgttccaagactgatacgttaatgtgg

SEQ ID NO: 41953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattttaaagactcaaactgccaatggtgtg

SEQ ID NO: 41954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattttagactttaacgctggggccgacgct

SEQ ID NO: 41955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattttccagatgctgtacaggcgtggcttg

SEQ ID NO: 41956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcattttgtgatggttgggtcctttagatggt

SEQ ID NO: 41957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcatttttaggatcagggacacccgggacgtt

SEQ ID NO: 41958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaaaaagatgtcgagcccgcatggattcc

SEQ ID NO: 41959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaaaccgacgggcaaccgccgttccggtc

SEQ ID NO: 41960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaaaccgaggggcttcatcaattaccagg

SEQ ID NO: 41961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaaagggagctactcaggttgtgtgacac

SEQ ID NO: 41962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaaattggccgtgtgttgagggcgcagca

SEQ ID NO: 41963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaaccataagagtcgatccagtagggggc

SEQ ID NO: 41964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaacgagttggatttatatggcagaatta

SEQ ID NO: 41965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaacgggtgagtctccctcgcggtacccg

SEQ ID NO: 41966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaacgtccgcgttcaccgggaagtacgat

SEQ ID NO: 41967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaacttggcaaatactttcccatagtacg

SEQ ID NO: 41968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaagagaacccctgatgtggggctgcggg

SEQ ID NO: 41969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaagggggtctggtcaggcaggggcagcc

SEQ ID NO: 41970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaagtgggtctctgtctctgggggtcgag

SEQ ID NO: 41971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaataagtgggttgtggcattcgttctcg

SEQ ID NO: 41972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaattagcttaattgctcttgaaactagg

SEQ ID NO: 41973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaattcccgggccgttcaccgagtgagaa

SEQ ID NO: 41974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacaaactccctggtgcgactcagcgaag

SEQ ID NO: 41975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacaacctcccgaccgtatcctcagccgt

SEQ ID NO: 41976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacaatctcacacaagtcgttaccagagg

SEQ ID NO: 41977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacacagacataggttttagcgtgcgcac

SEQ ID NO: 41978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacacgcgggtgcagacatggcagggcgg

SEQ ID NO: 41979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacactcgcggataagaatcgtgtttcgg

SEQ ID NO: 41980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacacttaatggcatggagtagccagcgt

SEQ ID NO: 41981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacagactgcgttgcttcacaagggattt

SEQ ID NO: 41982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacagcagtactcggcctattcattgctc

SEQ ID NO: 41983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacagcatgacttgctcgacattgaacct

SEQ ID NO: 41984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacagtattcgtgacacgcggtctcgtgg

SEQ ID NO: 41985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacatgttgagattttggtcagggaaagt

SEQ ID NO: 41986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacattagccgtgttaaggttcatggcta

SEQ ID NO: 41987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaccaatgaccagctggagggcatgtgtc

SEQ ID NO: 41988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaccacgccgcgctcgagcgatggtaccg

SEQ ID NO: 41989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaccagcttcatcttacggctgttttggg

SEQ ID NO: 41990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaccgcctctaatacaggtcgcggcgtga

SEQ ID NO: 41991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaccttttctctagtacgcgagaattgcc

SEQ ID NO: 41992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgaccgagcactcgatcaaacgctata

SEQ ID NO: 41993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgatgggtagcagaacaagcgtatgat

SEQ ID NO: 41994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgcattgacagcctaatgcctcccccc

SEQ ID NO: 41995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgcctgacgcgagcccacggatcagct

SEQ ID NO: 41996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgcgcgagggtctttgttttcttatca

SEQ ID NO: 41997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacggaccaggacggccgctttaggttgt

SEQ ID NO: 41998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacggacgacggcggtggatactcgcgtt

SEQ ID NO: 41999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgggcaactgcgtctcccacctatcgg

SEQ ID NO: 42000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgggctgtttctgctgtgtatggtcta

SEQ ID NO: 42001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacggtactgagatagctagaacagctta

SEQ ID NO: 42002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacggtcggtaataattgggcagcggaat

SEQ ID NO: 42003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacggtgcggtgcgcagtagtgctagtcc

SEQ ID NO: 42004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacggtgtcgagtgggggacgcatctacg

SEQ ID NO: 42005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgtcgctttgggagtggcttaacagtt

SEQ ID NO: 42006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgttgctttaggcgtgtttgatctgct

SEQ ID NO: 42007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaacgtttagaacattgcgtcatctttcgt

SEQ ID NO: 42008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaactcccccgtttacagtggttgatgttg

SEQ ID NO: 42009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaactgtcattagaaacttgaaccgttgtt

SEQ ID NO: 42010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagaaggcgtacccgacagcttgatccat

SEQ ID NO: 42011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagaccgtgatgctcgctcactacgcgac

SEQ ID NO: 42012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagcatctcgagacacgggatgagacggg

SEQ ID NO: 42013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagcatgtctggctttcccgggtaggatg

SEQ ID NO: 42014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagcatttggtgagctttgtgacgaggat

SEQ ID NO: 42015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagccgggtgatagtgcaaccagtttaga

SEQ ID NO: 42016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagcgggtctactatatgatcctgcccga

SEQ ID NO: 42017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggacaaaacgggcaagtccatgccgga

SEQ ID NO: 42018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggaccctgaattcgcgcgatacttcac

SEQ ID NO: 42019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggcgagagccttgtgttgtccgaagct

SEQ ID NO: 42020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggcgcgccttacaagacgttagttcgg

SEQ ID NO: 42021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggcggacgctccagacccgcattctac

SEQ ID NO: 42022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggcggagggaggtgggggtattggggt

SEQ ID NO: 42023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggcggcaacgcgtggtgacctggggaa

SEQ ID NO: 42024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggcttactgcagattaggtgcagtaga

SEQ ID NO: 42025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggggctaaacattggggaacgtggcgc

SEQ ID NO: 42026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaaggtcgaagactgagataatcgaaatgg

SEQ ID NO: 42027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtaatctagggcggatattcttttgcg

SEQ ID NO: 42028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtacggctccatcaagacccgagttac

SEQ ID NO: 42029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtagttatacggcacgcggtgtagacg

SEQ ID NO: 42030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtccgtttttgttgtttggtccttcga

SEQ ID NO: 42031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtcggtccagctcgtgggtatgccccg

SEQ ID NO: 42032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtgcagggcagttgtaaggtttggttt

SEQ ID NO: 42033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtggggaagctagatctacaggttcgc

SEQ ID NO: 42034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtgtccacttcgacccccagaacgcct

SEQ ID NO: 42035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagtgtttgacgtcgtggctattcggatt

SEQ ID NO: 42036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagttccgcgcgcccgacgacaactggta

SEQ ID NO: 42037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaagttgttagactccacgacgcttcacgc

SEQ ID NO: 42038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaataagcgtgtcatcatcgtcgcaagtgg

SEQ ID NO: 42039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaataagtatcgtgtaaatacttagcaatc

SEQ ID NO: 42040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatacttgtaagctgaatggcttcacgcc

SEQ ID NO: 42041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaataggtctacaccgggacctgactcagc

SEQ ID NO: 42042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatagttctcgaacataactcttacacac

SEQ ID NO: 42043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatataggttgtggtgctgtgcgttcggg

SEQ ID NO: 42044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatatcgagcggctcgtgaggtcgtggcg

SEQ ID NO: 42045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatcagtgaggtggtgtatgtgagtcagg

SEQ ID NO: 42046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatcgcagtgaacattgtgcgtacaaatg

SEQ ID NO: 42047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatcggtacgaagtctctagagacgttca

SEQ ID NO: 42048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatcggtcacttttgcaaaatttgcggcc

SEQ ID NO: 42049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatcggttctactgtctgggtttaatctt

SEQ ID NO: 42050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatcgtgacgcaatttcatccgtggaccc

SEQ ID NO: 42051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatgaggtagacagggcgctttctattgc

SEQ ID NO: 42052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatgcatactcggcggatggttatcgccg

SEQ ID NO: 42053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatgcatcacaggatttcccttttgtagg

SEQ ID NO: 42054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatgccaatcaggtgcagctactggcgta

SEQ ID NO: 42055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatgcggtgaggaggacccgtaagagttt

SEQ ID NO: 42056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatgttggcagtcaacgtcctctgaggct

SEQ ID NO: 42057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaattactcagtgtttagcaccttaattcg

SEQ ID NO: 42058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaattatcccgaggaaacaacctagactgt

SEQ ID NO: 42059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaatttgaggcagctcacggcaacgtgtcg

SEQ ID NO: 42060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaaagccaagggaacggatctgttcctc

SEQ ID NO: 42061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaactaagatcactggtcaggttagtta

SEQ ID NO: 42062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaagaacaagcggcccggtgacgtcggc

SEQ ID NO: 42063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaagttgtctgattttctttaaacagcc

SEQ ID NO: 42064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaatcgtcaggaacacagcgtctgtggg

SEQ ID NO: 42065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacactggtgacagaatatgacgggtcg

SEQ ID NO: 42066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacaggaataacgaccgctgatttttgg

SEQ ID NO: 42067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacatgggctagccaatacgcaatcgaa

SEQ ID NO: 42068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacattaacgatccgtatgtgtcttggt

SEQ ID NO: 42069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaccacacaggcttggctcttggataag

SEQ ID NO: 42070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacgcctggtcagttcctgccccgcagc

SEQ ID NO: 42071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacgttgaacagtcgctaggtcgtgtgt

SEQ ID NO: 42072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacgttttagattcatggtgcggaactg

SEQ ID NO: 42073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacacttctcggagccgcagattttgccgg

SEQ ID NO: 42074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacagctggggagtatacgagggttttctg

SEQ ID NO: 42075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacaggactgccagctggtccaccgcagga

SEQ ID NO: 42076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacagtagtttcgttcgagtgcgacgtcat

SEQ ID NO: 42077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacagtctgtaaaccagagttttgtcatac

SEQ ID NO: 42078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatcagatcggtgtcccagctccgcatc

SEQ ID NO: 42079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatccacgctacgacccgccgaccgttg

SEQ ID NO: 42080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatcctgcatcgttctgtcgcgcccgca

SEQ ID NO: 42081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatccttctggcgcttactatcttctct

SEQ ID NO: 42082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatcgcagctgaccgttagttcagaatc

SEQ ID NO: 42083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatgcacacgcactccccaaacgacgca

SEQ ID NO: 42084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatgcttagagacgtgcagtttggatac

SEQ ID NO: 42085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatgcttcgtgttcaggcttccgcggct

SEQ ID NO: 42086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatggctcgctccattgatgtattgtac

SEQ ID NO: 42087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatgtcggcaactcgctcttaccgggag

SEQ ID NO: 42088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacattatgtgggcggcattctcgctccgt

SEQ ID NO: 42089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacatttgaagcgttgcgttgacgagattt

SEQ ID NO: 42090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccaatgaatcggcacaggatatagctct

SEQ ID NO: 42091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccacaacgtggaaatagatagacacacc

SEQ ID NO: 42092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccacagtccatgggagcaatgggcatcg

SEQ ID NO: 42093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccagctattcaactcaccacgtgaggca

SEQ ID NO: 42094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccatgcttatcaatcaaaggcgctgttt

SEQ ID NO: 42095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccatgttccggtgtaaggtcgcaggcca

SEQ ID NO: 42096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacccactttttctcacgtagagcatctaa

SEQ ID NO: 42097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacccccctccaagtacgcgacggttggtt

SEQ ID NO: 42098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccccgagcacagttgttcctaaggcgcg

SEQ ID NO: 42099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccccgtcagagaggacgcaacgggttgt

SEQ ID NO: 42100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacccgagcttggtaacccctgcaatacat

SEQ ID NO: 42101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacccgccaccgaacattctttatcacggg

SEQ ID NO: 42102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgaacagaattgaatactgtttgcctc

SEQ ID NO: 42103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgactgggctgagggtacgctcggatg

SEQ ID NO: 42104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgagcagagcgggattttcgtcatgcg

SEQ ID NO: 42105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgataagcatacaaccaatgatcagtg

SEQ ID NO: 42106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgcagattcggttgtttccgttatagt

SEQ ID NO: 42107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccggactcggatgaacctacgctccgtc

SEQ ID NO: 42108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgggcaaagagtatcacgacgtatcca

SEQ ID NO: 42109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccggttggatttcgcacacttcccactc

SEQ ID NO: 42110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgtaaggacaagagtgcctcgaatgca

SEQ ID NO: 42111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgtgcactgcggacatctgggtctcga

SEQ ID NO: 42112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgtgcatcttctagtacaaagtcggcc

SEQ ID NO: 42113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgtgtgaacctgggaggccgctcaccg

SEQ ID NO: 42114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccgttttctgagcgtttagacttttaat

SEQ ID NO: 42115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacctcaccgtccacgtttctgctgcgtac

SEQ ID NO: 42116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacctctaaacatatgccttctcactggga

SEQ ID NO: 42117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacctctatcttaatcagcgtatcgctcgc

SEQ ID NO: 42118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacctgagttcgctcttactgacgtagggc

SEQ ID NO: 42119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacctgggaggtctatactgccattctgtt

SEQ ID NO: 42120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaccttataaatcatcattctgtactttat

SEQ ID NO: 42121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgaagaatatatgcttgtcttggcatct

SEQ ID NO: 42122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgacactaagaaccccggtgggacgcgc

SEQ ID NO: 42123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgacttatgcgaatctgcgttgggtttg

SEQ ID NO: 42124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgagaacgaatagctgacttgcggtcgc

SEQ ID NO: 42125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgagagaagccaagtgtttgtggtgtgc

SEQ ID NO: 42126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgagcaaccaactagacaacgacctggt

SEQ ID NO: 42127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgagctgtagccaagggggtcacggggg

SEQ ID NO: 42128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgaggtcaacaaacggcattcgggggcg

SEQ ID NO: 42129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgagtgctatctgttgttgccggcagag

SEQ ID NO: 42130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgatattactccaaacgcctagttacct

SEQ ID NO: 42131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgatgatttatgccggtactatcacggg

SEQ ID NO: 42132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgatttaacacgataattcggctggggc

SEQ ID NO: 42133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcatccaggtcggctgctattcacatc

SEQ ID NO: 42134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcatgcaaatagatgcaagatcgcgga

SEQ ID NO: 42135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgccgagcacacggttctcgaggaagtc

SEQ ID NO: 42136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcgatcactgacaagagagtatgaacc

SEQ ID NO: 42137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcgcaacagtattcctgcgcactatct

SEQ ID NO: 42138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcggctagttggttatccgttaacgta

SEQ ID NO: 42139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcggtttgcgagcggagtggtaataac

SEQ ID NO: 42140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgcgttgctaccggtgggtcaaatgaat

SEQ ID NO: 42141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgctgtagataacgattaatgtaacaac

SEQ ID NO: 42142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacggacgcttccccctgttgacgcggtgc

SEQ ID NO: 42143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacggactcctcatccgtctcggtctgggg

SEQ ID NO: 42144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacggcccacgtaggaagccacttgcaacg

SEQ ID NO: 42145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacggctatgcactgacacaagcccggcat

SEQ ID NO: 42146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacggggtaggaagctccatggtctagtcc

SEQ ID NO: 42147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgggtatggcgctgcagtacgcggtttt

SEQ ID NO: 42148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgggtgtgttgtaatgatggcaagtaat

SEQ ID NO: 42149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacggtagagcgctcatcgttcgatcaccc

SEQ ID NO: 42150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtagcgcaatttccgtcggagaacacg

SEQ ID NO: 42151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtatttcgtcgtcagtatgttgcagtt

SEQ ID NO: 42152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtcacagcaagcggtcttggaatggac

SEQ ID NO: 42153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtccttccgattcgatacgtgtctgtg

SEQ ID NO: 42154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtctgactcgcagatgctgcttcgcct

SEQ ID NO: 42155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtgaagtcgtcaggccgtattatctgg

SEQ ID NO: 42156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtgataagcgcccctgccctgatcgag

SEQ ID NO: 42157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtgcgacaggcatgtgaagttcgccct

SEQ ID NO: 42158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtgcggaaacctgtgctgtttgatccc

SEQ ID NO: 42159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtgctatcgtttcggatcccattgagt

SEQ ID NO: 42160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtggggttttctgcctaggcgtatgct

SEQ ID NO: 42161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgtggtgatgtgcttcgaacgtacggtt

SEQ ID NO: 42162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgttaactctacccggataggttgtgga

SEQ ID NO: 42163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgttattgatcattatcgattgtgcgta

SEQ ID NO: 42164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacgttgaaatgtgctcgggtccgccgcct

SEQ ID NO: 42165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactaaacaatgtacaagtgctctatccgc

SEQ ID NO: 42166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactaagtgaatcgccttgtgctgtgtgag

SEQ ID NO: 42167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactactacagtttcctgcggcggcttttt

SEQ ID NO: 42168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactactcgtctgggttattctgatgtggg

SEQ ID NO: 42169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactatctgaccactttctagtcaacttat

SEQ ID NO: 42170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactattcccgctgacaccatgccaaggcc

SEQ ID NO: 42171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactcataagaataatctactgtgtgtcga

SEQ ID NO: 42172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactcgcgcaatccggacgcttatttttta

SEQ ID NO: 42173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactcggacgttttatatgcaattgcgttg

SEQ ID NO: 42174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactcggcagctgttgcggccagtattccg

SEQ ID NO: 42175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactcgtagttccgcattggggatgcttct

SEQ ID NO: 42176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactctcgtctatgctactctacagtactt

SEQ ID NO: 42177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgactttcgccttatgttaccagccaa

SEQ ID NO: 42178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgaggtgttccgagcgaacgtgtggac

SEQ ID NO: 42179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgagttgtaatcacgtaatcatggtcc

SEQ ID NO: 42180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgatggacgagcgatcggaaccagcct

SEQ ID NO: 42181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgcagcgtgtccgaactcagtgatggt

SEQ ID NO: 42182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgccagccgggatcctcttcctctgct

SEQ ID NO: 42183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactggagaaggcgtgtacggagcctcgtg

SEQ ID NO: 42184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgggatttgctgcacctgaggatcacc

SEQ ID NO: 42185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgggtctaatgtattattgtcgccgct

SEQ ID NO: 42186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactgtcggctcagtttaagattgtgcggc

SEQ ID NO: 42187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacttaacttctcccgtaccgagacatgct

SEQ ID NO: 42188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacttaagcagagttgcttatcaatcaacg

SEQ ID NO: 42189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacttgatttgaggttattcggaattatcg

SEQ ID NO: 42190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccactttgcccgtcacgtggtctgccgattt

SEQ ID NO: 42191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccacttttatgatcattcttagtggtcgggc

SEQ ID NO: 42192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagaaatgcgtaagggcttggcggcggcgt

SEQ ID NO: 42193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagaacgcgtgggtcaacccctcgagtaac

SEQ ID NO: 42194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagaactgcactgaacccgccacggtgaac

SEQ ID NO: 42195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagaatgcctcgcgagctcccatgttctag

SEQ ID NO: 42196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacaacgatctgggaaaggttctctttt

SEQ ID NO: 42197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacaagatgggtgcgatggtcgtgatcg

SEQ ID NO: 42198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacatcacccttgaacgtgcccgcggct

SEQ ID NO: 42199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacgactcgatccatttggctaatggct

SEQ ID NO: 42200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacggggacacgttacatgccggcatcg

SEQ ID NO: 42201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacgtcatgtgctgcggctttcgctccg

SEQ ID NO: 42202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacgttttacccgacgacgctgctttgc

SEQ ID NO: 42203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagactcaactagcgggtcttcgtaccggg

SEQ ID NO: 42204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagactcggatttttgtatttcgaactcta

SEQ ID NO: 42205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagacttgcggatttaatgtggctacggcg

SEQ ID NO: 42206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagactttaccgtcctccggagaaatggcc

SEQ ID NO: 42207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagaggatacagtcccccgagccgagga

SEQ ID NO: 42208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagcatgatgttgttagcgactttgcgg

SEQ ID NO: 42209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagcgggattaaactgtcgggaagccca

SEQ ID NO: 42210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagctattctatgatcaaccccgccttt

SEQ ID NO: 42211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagctgacctttttgctcatattcaacg

SEQ ID NO: 42212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagggtagagcactgacaaggaggggaa

SEQ ID NO: 42213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagaggttagggatggttctggggtaattg

SEQ ID NO: 42214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagtcggggcaatcgtgaggctcggcac

SEQ ID NO: 42215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagagtctgacgggccagtctgcagatgct

SEQ ID NO: 42216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagataaacgacccgaatcaggcgtgtggg

SEQ ID NO: 42217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatcggagcctttgactgtgggttcgtc

SEQ ID NO: 42218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatcgtcacggtgcacccggaatcggat

SEQ ID NO: 42219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatcgtttgcctctgggagccggcggcg

SEQ ID NO: 42220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatctaggcaggttgaaacctgatgatt

SEQ ID NO: 42221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatgatggggttaatgcttgtaaacagc

SEQ ID NO: 42222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatgcggatgtgactaaagggttcactg

SEQ ID NO: 42223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagatgtggaggccgggacaatcgatggca

SEQ ID NO: 42224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagattgaagggttgcagcgcggttgctcg

SEQ ID NO: 42225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagattgatctcctggtgtgccgccagtgc

SEQ ID NO: 42226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagattggtctttcctcgagtattctttaa

SEQ ID NO: 42227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcaaacctccacgttagtcattgggtgt

SEQ ID NO: 42228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcaacagcctcggaagcatccagggcgc

SEQ ID NO: 42229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcagggcgacgtcagtttagtggtctgg

SEQ ID NO: 42230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcatagttttccccacgctcactctacc

SEQ ID NO: 42231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcatcactacggacctgagcgggactgg

SEQ ID NO: 42232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagccccggttcaagcaaacgccggtttaa

SEQ ID NO: 42233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagccgagcgttcgttgttgtctttcatcg

SEQ ID NO: 42234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagccgaggggtgaaggaccatactcgttt

SEQ ID NO: 42235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagccggaggtactatgacgcatttaacgg

SEQ ID NO: 42236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagccgggtaagcctgtccgcatttggtgc

SEQ ID NO: 42237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcctttggtcgctcgttgctttactgga

SEQ ID NO: 42238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgaaacaccggatcaagggaaggcgta

SEQ ID NO: 42239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgataccacgggccccggtcacacaag

SEQ ID NO: 42240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgctctaagtatccgaggtctctccta

SEQ ID NO: 42241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcggacatcagcgtatggtttaatcaac

SEQ ID NO: 42242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcggagcagacgggcatggcgttgcgtc

SEQ ID NO: 42243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcggcgtaagatgctgtcagcgctgagg

SEQ ID NO: 42244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcggtgagcttcaactgtccaactatgg

SEQ ID NO: 42245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgtactcaagattgtcggtcggtattt

SEQ ID NO: 42246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgtgtggacagggcactaaacgaaacg

SEQ ID NO: 42247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgtgtgttcgttacggatttgaaaagc

SEQ ID NO: 42248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgttgctatcttgactatcatctgtgg

SEQ ID NO: 42249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgtttctgccttttacaattgttattt

SEQ ID NO: 42250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcgtttgatgcttaccctgtgcattcaa

SEQ ID NO: 42251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagctctttccggtttgttcgaagtctgcc

SEQ ID NO: 42252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagctgagctcgagatccacatgttcgctg

SEQ ID NO: 42253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagctggctcatgctccgctcgttcgttcc

SEQ ID NO: 42254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcttattccgatacggtcggtgggaggt

SEQ ID NO: 42255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcttgagttcaaccgtgctcgtaccgcc

SEQ ID NO: 42256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagcttgattctcaaccgtctgcatgaact

SEQ ID NO: 42257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggaactagttgcttggacgcttatcctc

SEQ ID NO: 42258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggaatacggcatcaatccggcgggccgc

SEQ ID NO: 42259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggacattgagactcgggtgattgatatc

SEQ ID NO: 42260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggaccccttggtatctttgtgttgttag

SEQ ID NO: 42261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggagcacccgcatacttgtggccgaggg

SEQ ID NO: 42262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggagcagaggtaaggtgacctaagtagg

SEQ ID NO: 42263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggagcggggatccaatggtcgatgcgcg

SEQ ID NO: 42264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggatacgagctcctacggcggggaaccc

SEQ ID NO: 42265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggattcgctgccgagtaagcagtttttg

SEQ ID NO: 42266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggattttccgccgtgccgtctcgtacgt

SEQ ID NO: 42267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcacaccacggcttgttcgcggtagga

SEQ ID NO: 42268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcacgttgcgggttcgatcactttgcc

SEQ ID NO: 42269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcactgaacagtagccaccacttgcct

SEQ ID NO: 42270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcaggtgcgttgagattggttctcctg

SEQ ID NO: 42271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggccagtcgagaagtgttgccccacacg

SEQ ID NO: 42272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggccgcccaaactcattatgtttccaaa

SEQ ID NO: 42273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggccttcattagagctgtgttgtctatt

SEQ ID NO: 42274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcgcgcctcctccacggtgcttaaggc

SEQ ID NO: 42275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcggatggttcggggtcccctcacgtc

SEQ ID NO: 42276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcgtatccgcatccgatgggctcgggc

SEQ ID NO: 42277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggcgtggagatgcattgatgcctggctc

SEQ ID NO: 42278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggacatgactcactagtccacgtcagg

SEQ ID NO: 42279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggaccatggtcgccaatgtgatttcgt

SEQ ID NO: 42280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggaccgcgttgagcattagattgggag

SEQ ID NO: 42281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggatgcccgatggttggcggtagcggt

SEQ ID NO: 42282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggcactaactccccagtaggcggatgt

SEQ ID NO: 42283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggcatggcgagtcctgacgttcacttc

SEQ ID NO: 42284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggctgggctggagttgacggagcgtgg

SEQ ID NO: 42285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggggcatgttgttattacggcgcagcgt

SEQ ID NO: 42286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggggctttaattgtaacatacgtgcttt

SEQ ID NO: 42287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggggggcgacctaacttgcttacccgtt

SEQ ID NO: 42288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggtaagtactcggggtgccactcgcgc

SEQ ID NO: 42289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggtaggtttgtactgcggtctgctttg

SEQ ID NO: 42290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggtcgatttcaaccaggaaccgtatcc

SEQ ID NO: 42291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggtgatcgtcggtcatgagcttcccta

SEQ ID NO: 42292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggtgcggaacagatgcataataatcac

SEQ ID NO: 42293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagggtggttttgccgacttctctaacagc

SEQ ID NO: 42294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggtaggctgtgaatctcgtaacgccttc

SEQ ID NO: 42295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggtcactcaccacagcggagtaacgagt

SEQ ID NO: 42296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggtgaaggtgccctgccgcaagacgcgg

SEQ ID NO: 42297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggtgaatatgtgactgcggaactgtgga

SEQ ID NO: 42298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggttacgccgcttctccgggtggttttg

SEQ ID NO: 42299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggttagtccttattgggcaatccatcgt

SEQ ID NO: 42300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggttctagtccccgtgcggcttagagcg

SEQ ID NO: 42301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggttgcgccatgcacagagggcttttgg

SEQ ID NO: 42302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccaggtttggatacgtcatgtatgaggcggc

SEQ ID NO: 42303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtaagattctgggaggaatatgccgatt

SEQ ID NO: 42304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtaagcgacttgtttatttgtcttcact

SEQ ID NO: 42305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtaagggggttcctgtataccaaccgaa

SEQ ID NO: 42306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtaattttctgactcgattaacaggtgg

SEQ ID NO: 42307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtacgtagacttctataggcctctttcc

SEQ ID NO: 42308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtacgtagcgacggggagggcggcggct

SEQ ID NO: 42309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtaggacacgtggcgcagtaattagagg

SEQ ID NO: 42310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtagtgtgcgaaggtcaaagccgcgcgc

SEQ ID NO: 42311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtagttaattgttccgcgcctactccaa

SEQ ID NO: 42312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtcacatcaacatgtcacgctcgatgcg

SEQ ID NO: 42313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtcgggcggtgaccaaaacggcgcaact

SEQ ID NO: 42314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtcgtgcgtgcccatggcaaggacgtgt

SEQ ID NO: 42315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtctccgatttgtatgcccaattggctc

SEQ ID NO: 42316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtgccctgtaagcccgacgatgcgaggc

SEQ ID NO: 42317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtgcgaggctcaactcggcctaaccttg

SEQ ID NO: 42318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtggggatagggcgatacacgtacattg

SEQ ID NO: 42319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtggggtaacgatggtcgaggtcggcgg

SEQ ID NO: 42320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtggtctccgccgaaatagttgcgaccg

SEQ ID NO: 42321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtgtttaagcttgtaatggtatctgtcc

SEQ ID NO: 42322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtgtttactcaataccaaatcgcctggt

SEQ ID NO: 42323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagttactgctattatggtcattacttcga

SEQ ID NO: 42324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagttgattacatgcacgcccgccaagagt

SEQ ID NO: 42325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtttcttccttgttgaatagcccgagcc

SEQ ID NO: 42326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtttggagcaactcgaagtctgatgatg

SEQ ID NO: 42327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagtttgttcatgagtagctgctttgacta

SEQ ID NO: 42328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccagttttgcaaagactccctcgctctacgg

SEQ ID NO: 42329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccataaaaaacgtcgttgcctgttcattggt

SEQ ID NO: 42330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccataaagagctcgtgtagcccgtcaacaac

SEQ ID NO: 42331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccataaaggtattcttctctgccaacgatca

SEQ ID NO: 42332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccataacccatctagaagccgattcactccg

SEQ ID NO: 42333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccataagagaaggttcttcttaacagtgcga

SEQ ID NO: 42334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccataaggttttattgctactgtgcacttgg

SEQ ID NO: 42335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatacactccgtacctccccacccatgact

SEQ ID NO: 42336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatacgacttcggtgttatcaggccgctgt

SEQ ID NO: 42337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatacgatagtgttcagctagcaactgggc

SEQ ID NO: 42338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatactgtcgcatcaacgatgcgatatgtt

SEQ ID NO: 42339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatagagatcgaagactgttctacgcgggc

SEQ ID NO: 42340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatagataactgtcggtctgcttgctgctt

SEQ ID NO: 42341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatagatcattctagagatgagtggggtag

SEQ ID NO: 42342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatagcggattcctgctctagttccagttt

SEQ ID NO: 42343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatagtcgatttggcagattcatgcttcga

SEQ ID NO: 42344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatagtgcgaagtcgtgatgagcgtctcgt

SEQ ID NO: 42345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatatcctgttgagggcgccggcgactctg

SEQ ID NO: 42346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatatggagacggtacatctcggtctcgta

SEQ ID NO: 42347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatatgtcggggtttggccgtctgctcatg

SEQ ID NO: 42348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatattaccggcaaaccataccactcggcc

SEQ ID NO: 42349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatattgtgtcctttgtgcgtggggccttg

SEQ ID NO: 42350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatatttatgtttgagtgcgcctaatgcca

SEQ ID NO: 42351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcaacccggctggattgcagacgagcgg

SEQ ID NO: 42352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcaagcgcgcaataacgtatcgcacggg

SEQ ID NO: 42353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcaagggcaagacaagatatacactcgg

SEQ ID NO: 42354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcaatactcaactagtgtgtcctccgta

SEQ ID NO: 42355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcactgtctctatcgtttatcagtgacc

SEQ ID NO: 42356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcagatgagtagtgttgggggtggcacg

SEQ ID NO: 42357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcagcacgatgtccgttgcagatcatgc

SEQ ID NO: 42358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcaggcgcgttaatcgtctggttccgtt

SEQ ID NO: 42359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcatcacttgtttgatatctgttcggtt

SEQ ID NO: 42360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcatggaggggcggtttccgaccggttc

SEQ ID NO: 42361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatccaccaactctgcttagttcacagccg

SEQ ID NO: 42362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatccacctgaccttctggcctaaacggga

SEQ ID NO: 42363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcccattttttctagaggtgtcatatgg

SEQ ID NO: 42364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcccgcgtccatgagtttcctcgtgccc

SEQ ID NO: 42365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatccgccagtgtgctgtcgaagtaatggg

SEQ ID NO: 42366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatccgtcgctagattgggggccagtgggt

SEQ ID NO: 42367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatccgttcaagttgctcaatcttctggga

SEQ ID NO: 42368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatccgttggctacgaccggatactacccc

SEQ ID NO: 42369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcctctatcgaccatttgcgagttgttg

SEQ ID NO: 42370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcgactagctcaaccaagtggcaaatgc

SEQ ID NO: 42371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcgcagtcacttcctacttgtgcggttg

SEQ ID NO: 42372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcgcggggaattgtgagactcgatggcg

SEQ ID NO: 42373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcgctgctagtatatcggttatggtctt

SEQ ID NO: 42374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcggttaagacaagccaatcgacgcgtc

SEQ ID NO: 42375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcggttgtgctggaagctttttgtccgg

SEQ ID NO: 42376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcgtcggtatcttaacgtgtgtgctcgt

SEQ ID NO: 42377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatcgttactgcattttgttttgtgtggtt

SEQ ID NO: 42378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatctagacagtgctttgtgggtacaagcg

SEQ ID NO: 42379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatctccgctcgcacgtgcatgctggtgtc

SEQ ID NO: 42380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatctcgctcattggcggcggagggttgag

SEQ ID NO: 42381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatctggatgtttagagaggcacacggcta

SEQ ID NO: 42382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgaaatggtcatgaggggcgaaaagagc

SEQ ID NO: 42383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgaaggatcaggagatgcacgatcatgc

SEQ ID NO: 42384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgacagacgagccacggtgtcccgggac

SEQ ID NO: 42385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgacgctgagcttctatacaaaggcctc

SEQ ID NO: 42386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgagggttctggaggggcgcggctgtgt

SEQ ID NO: 42387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgatcgtgcggaagggttgttttgttac

SEQ ID NO: 42388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcaacctctatatagctcaggcgcgtc

SEQ ID NO: 42389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcaactcatcctttcgggatggggtct

SEQ ID NO: 42390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcaatccgtgaccaggactgcgttttt

SEQ ID NO: 42391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcaatgtacatcctgattagctcattg

SEQ ID NO: 42392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcagcttaaacgatctcctggtgttgt

SEQ ID NO: 42393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcatcaatacctcctggtcgggtggcg

SEQ ID NO: 42394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcatccggtttctaatcgtcggcacaa

SEQ ID NO: 42395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcatggggaacgcctgtggttaagtgg

SEQ ID NO: 42396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcctaagcggttgttcctacgaagtca

SEQ ID NO: 42397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgcgatgtgttaacgatgtacttgctgt

SEQ ID NO: 42398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgctccttatgtctcattatcggtccga

SEQ ID NO: 42399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgctgcttagatttcccatcccatgcgc

SEQ ID NO: 42400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgctggtaactggtctgcgtttggggtg

SEQ ID NO: 42401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgctttgaccgtcctagactaccgcttg

SEQ ID NO: 42402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggaatgaacggggatgagcctgcttct

SEQ ID NO: 42403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggaatttaggtcggaagggcgtattgc

SEQ ID NO: 42404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggacgttcttcttttagagttccagtc

SEQ ID NO: 42405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggatcttcccccgtggccttttcttca

SEQ ID NO: 42406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggatgagtcgggtctcggaacgggcgt

SEQ ID NO: 42407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggcatctggtcaatgtgggggcgaaca

SEQ ID NO: 42408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggccaatgctctcatagatgcccgcgt

SEQ ID NO: 42409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggctgtcgcgtcggtgagatacgctca

SEQ ID NO: 42410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgggaacaagcggagcagcctgttgggg

SEQ ID NO: 42411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgggagggaatatacgttactggatgcg

SEQ ID NO: 42412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggggaacccagcgtacatcggctttgc

SEQ ID NO: 42413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggggcatgctgcttaggccactacaaa

SEQ ID NO: 42414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggtacaacatgtcgggagaaccggctg

SEQ ID NO: 42415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggtgcggcaccacagtttgcgattttg

SEQ ID NO: 42416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggttccgcagctctggattcgtcaaga

SEQ ID NO: 42417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatggttgctatctaacactcgcggttccg

SEQ ID NO: 42418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtaaggcgtacatggtctcggcgcgtc

SEQ ID NO: 42419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtagtacgctctagaccagggttgggc

SEQ ID NO: 42420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtatgtcggagcccaccttgttggcat

SEQ ID NO: 42421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtcattagtcttacggatgctccccga

SEQ ID NO: 42422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtcgaaggaagttggtagcacggtttg

SEQ ID NO: 42423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtgaaagctatgcgacgacaaaggacg

SEQ ID NO: 42424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtgcgctgtggtagctcgacgcgttgg

SEQ ID NO: 42425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtgggaggcagcaccgtgggttggtgc

SEQ ID NO: 42426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtgtggcgtaggcaaagtataccggcc

SEQ ID NO: 42427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatgtttactcagtccgagctaattctggg

SEQ ID NO: 42428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattaaccgtttctagcaaagttaccggtc

SEQ ID NO: 42429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattacggcggtgaacattcttgagggtcg

SEQ ID NO: 42430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattaggcgtagtttcttgtcgcgacgtcg

SEQ ID NO: 42431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattattcgtctagcgtatgttagtcgggt

SEQ ID NO: 42432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattcacccagggactcgcggcaccccctt

SEQ ID NO: 42433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattcagggagcaaggccgcacaatgtcgt

SEQ ID NO: 42434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattccaacgtgaagtcgctccccgtttta

SEQ ID NO: 42435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattcccatgtgtaggagtaaacagcgttc

SEQ ID NO: 42436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattcgaccagcggtcggcgatgcgattac

SEQ ID NO: 42437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattctcttataccgccgcctctagttggt

SEQ ID NO: 42438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattctgccggcacccgtcctagtgatgtg

SEQ ID NO: 42439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgacactgactgctatgggtaactgat

SEQ ID NO: 42440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgagccagtctgttcgtttccagcgcg

SEQ ID NO: 42441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgatgtcagcatgtttattagaatgtt

SEQ ID NO: 42442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgattgcctggtgcttaagtaatgggt

SEQ ID NO: 42443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgtaaggtagcctatcggtcttcggtg

SEQ ID NO: 42444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgtcgtactgagcgtgtaccaaagacc

SEQ ID NO: 42445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattgtcgtggggcaggttggttcaattgc

SEQ ID NO: 42446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatttacgctatgttgcgctcgcccggttc

SEQ ID NO: 42447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatttagtccgccctttccggagactgtcc

SEQ ID NO: 42448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatttatgttccttggactgcacggtcatt

SEQ ID NO: 42449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatttccgactggactttcacaggagcgat

SEQ ID NO: 42450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccatttccggtgggtacatgtccgtatgtcg

SEQ ID NO: 42451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattttagcggcctggattggcatgacggt

SEQ ID NO: 42452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccattttctgtgtctccaaggcaaagacgta

SEQ ID NO: 42453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaaaaaataatacttctcgcctctctacg

SEQ ID NO: 42454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaaacgtccggacacgttgtcatgccgca

SEQ ID NO: 42455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaaagtcgccagtatgtcgaagtccctgg

SEQ ID NO: 42456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaaattacgacttgtttgtccttagcggg

SEQ ID NO: 42457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaacgcgtaggtagtgtcaccgtcatcga

SEQ ID NO: 42458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaacgttcgcgactcctgaggtaatatgg

SEQ ID NO: 42459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaactagcgtggcgtgctccagagtatgg

SEQ ID NO: 42460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaactgctggccgctaatgattacacgag

SEQ ID NO: 42461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaactgtgacacatccgcgcgccgattcc

SEQ ID NO: 42462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaaggaatggtgctaatgcggtgcgaatt

SEQ ID NO: 42463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaaggacgagtgcagtgtggctggagtgg

SEQ ID NO: 42464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaatacccaggccacggagcgctcgcggc

SEQ ID NO: 42465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaatgaatgccctttatatgcgccgtggt

SEQ ID NO: 42466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaatgcaattgtttcaagcagtgcataca

SEQ ID NO: 42467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaattacagtatcgaagcatccaggtagg

SEQ ID NO: 42468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaattgccaagctagcgcggtcaggtggc

SEQ ID NO: 42469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacaaaacgagatccaagcacctccccgg

SEQ ID NO: 42470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacaagttcgcacgtttgatagggtactg

SEQ ID NO: 42471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacacagccagtgctcgctgtgggttttc

SEQ ID NO: 42472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacacccggattctcgcgttcactaatat

SEQ ID NO: 42473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacacgtcgtcgtgatcgtgagggaggtc

SEQ ID NO: 42474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacatatctttaaggcgacgcgcgcgtgt

SEQ ID NO: 42475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacatcctaggtatggttgatacattgta

SEQ ID NO: 42476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacattaagcgtacaccagtcgtctgcta

SEQ ID NO: 42477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacattgcaggcgctttgaccttcgagcg

SEQ ID NO: 42478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaccaaggctacacgctgtttcttgttac

SEQ ID NO: 42479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaccacgtagcctgcgtggtgcttatacg

SEQ ID NO: 42480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaccagtctccccgatgcgatgtcccacc

SEQ ID NO: 42481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacccaagcgaaatgatctcgagtttacg

SEQ ID NO: 42482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacctaaggagagcggcaaatagccagat

SEQ ID NO: 42483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgacacggtcatgtgattgctcggttg

SEQ ID NO: 42484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgcaggcagtatgctttactcaacgcg

SEQ ID NO: 42485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgccttcgttttcccccttttacgagt

SEQ ID NO: 42486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgcgacgcattaatgacggctctggtt

SEQ ID NO: 42487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgcgcgtactcccaatgaatcccgtgc

SEQ ID NO: 42488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgcgttctccatcttagctgacgcatc

SEQ ID NO: 42489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgcttacgcaggatgttatcgaggatc

SEQ ID NO: 42490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacggatgtggcgcatgcataaagtatgc

SEQ ID NO: 42491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacgggaatgcgcgagagtaggtcttgtc

SEQ ID NO: 42492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccactgttgctggaggagaaaggtaaagtc

SEQ ID NO: 42493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacttcttcgcgattaattgctgcagccg

SEQ ID NO: 42494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccacttgtatagcctcactcgctggattgg

SEQ ID NO: 42495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccactttaacttttgaatatgttcggaggc

SEQ ID NO: 42496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagaaataagcagataattcggttaatca

SEQ ID NO: 42497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagaatgaccaccgtttgaagtgcaagtt

SEQ ID NO: 42498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagacgcaaccctcacttggacatactcg

SEQ ID NO: 42499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagcaaaagacagcggggctaggatctcg

SEQ ID NO: 42500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagcaaacttgggtttggatttacaaccg

SEQ ID NO: 42501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagccagcctccgttcgatttcctgcgtt

SEQ ID NO: 42502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagcgaagcggaacggtcagtctgattcc

SEQ ID NO: 42503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagcgactataggcggctggtgtgtcata

SEQ ID NO: 42504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagcgcgatggtccggaaggggtgatgcc

SEQ ID NO: 42505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagcgtcatggcggcaatgctcgtttctc

SEQ ID NO: 42506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaggaacactagtcgaaccgtgagcgcgg

SEQ ID NO: 42507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaggggtgcggttgagacagtctgaccgt

SEQ ID NO: 42508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagggtaatgccgcaacgatcattgtgag

SEQ ID NO: 42509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaggtcgtcaaggttcaggtgggtaatcc

SEQ ID NO: 42510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaggttctgcgtgatttgaagcatagggt

SEQ ID NO: 42511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccaggtttcaccttgtgatccgtgcgacgc

SEQ ID NO: 42512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtacacggttgctcgggttttgccaaa

SEQ ID NO: 42513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtcaaccgtagttacctgctgtgttca

SEQ ID NO: 42514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtcaatacgggtccgcccgcctcccgg

SEQ ID NO: 42515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtccatacgtagtggaggggaacagtc

SEQ ID NO: 42516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtccggggggtgactagtcgtatgaag

SEQ ID NO: 42517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtgggcatcacccttggacgacccgca

SEQ ID NO: 42518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtgtggcgtagggcaatcttctgtccc

SEQ ID NO: 42519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagtgtggtgcgatctctacgttatttgc

SEQ ID NO: 42520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagttccggcaaaaaaggtccggggctgt

SEQ ID NO: 42521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagttgaattccgcgtatccccgaggtgt

SEQ ID NO: 42522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccagttgggttagcatcgtggaacttgact

SEQ ID NO: 42523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatacgatgcacccgtcgcacgcgaaaaa

SEQ ID NO: 42524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatatatcggctctgcgaattttccagcc

SEQ ID NO: 42525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatcatggtaatcctttgcctagtcaccg

SEQ ID NO: 42526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatcatgttgaacctcctagatcttgaat

SEQ ID NO: 42527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatccggatatagcgtcgtcttgattgtc

SEQ ID NO: 42528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatcggcatacctgcggagttgcgcacgg

SEQ ID NO: 42529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatgacctgttgttcactgtgtggcttga

SEQ ID NO: 42530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatgctcctcttggttccggacgcacacg

SEQ ID NO: 42531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatggctgggttttctcggatgcggcggc

SEQ ID NO: 42532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccatgtcgtccagactcgaatgagttcggt

SEQ ID NO: 42533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccattaatccgctctgacatcgtgcgtcgt

SEQ ID NO: 42534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccattgaatcatccttgcgcttggacaacc

SEQ ID NO: 42535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaaatatccgtccgttgaggcgtaccgc

SEQ ID NO: 42536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaaatatcttttgatgaggtggctaata

SEQ ID NO: 42537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaagagcagacgctggtactgaggaggc

SEQ ID NO: 42538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaagggtgatgacggacgagcgtatctg

SEQ ID NO: 42539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaatgtagccaagcgatttatgctttcc

SEQ ID NO: 42540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaattaactccgttagctcactacagat

SEQ ID NO: 42541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccacagctcctttatcattgctcgcccgg

SEQ ID NO: 42542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccacatcgtatagctactcatcgctccgg

SEQ ID NO: 42543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaccaacgtagaggagtgaagctgcagg

SEQ ID NO: 42544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccacggtctcgggggtagagcatctccta

SEQ ID NO: 42545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccagaggtgtcaggttgctgcgccttcac

SEQ ID NO: 42546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccagctcgtttaatcagtggtaatgtggc

SEQ ID NO: 42547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccaggcgcgacggaagtcacgaccgcata

SEQ ID NO: 42548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccagtggggattggcttctgctgtctaca

SEQ ID NO: 42549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccatactggacaagttcggatgttgtgcg

SEQ ID NO: 42550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccatcatcttgtattcagacgagtcaggg

SEQ ID NO: 42551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccatccgccatttagcattaaacatcggt

SEQ ID NO: 42552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccatggagctaccgtcgctatcgggaggt

SEQ ID NO: 42553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccatgggttcacgggtaccaggtatgtgc

SEQ ID NO: 42554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccattagagacttagagatcctaatagcg

SEQ ID NO: 42555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccactgcaatgtaacttgtctagcacgg

SEQ ID NO: 42556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccagggatgtgttcgtctttggttccgt

SEQ ID NO: 42557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccatacactttccgattgatagtgcggg

SEQ ID NO: 42558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccccgacaaggctccctaggtattcggtt

SEQ ID NO: 42559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccctcaaactccatccacgacctaatga

SEQ ID NO: 42560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgagcgcactcatccccccccgtctgt

SEQ ID NO: 42561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgcaaaacgttcgttgtttgtgtcccc

SEQ ID NO: 42562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgcagaggagcggtacgtttgccgcaa

SEQ ID NO: 42563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgccagcccttggtatagcttcccggg

SEQ ID NO: 42564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgcgcgccctcgttattgttcactctc

SEQ ID NO: 42565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgtacgtacgaaggtggtgcacaggtg

SEQ ID NO: 42566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccccgttcggctacgcacgtccccgagttt

SEQ ID NO: 42567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccctggttccttagttaaagcttatggct

SEQ ID NO: 42568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccctgtcaacgccaagtccgggaagagcc

SEQ ID NO: 42569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgaacaattggaaaggttcgttcctccg

SEQ ID NO: 42570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgaactagagggtgtcagctcggcgggc

SEQ ID NO: 42571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgagctatgtgtcgactttgctgcttgt

SEQ ID NO: 42572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgaggttggtcgaaacggaatacgaccg

SEQ ID NO: 42573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgagtgggtaaactctccagtacgctag

SEQ ID NO: 42574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgatacttgggatacgttggagtggctc

SEQ ID NO: 42575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgcacacccctgtcatgacccttcgacc

SEQ ID NO: 42576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgcaccgtttcgcattcgtattgctggc

SEQ ID NO: 42577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgccagctgtgacccggcttagcgctcc

SEQ ID NO: 42578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgcgacgtactgcttttaggagcctgtc

SEQ ID NO: 42579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgcggcgcggtttggaatatttagcact

SEQ ID NO: 42580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgcggtgtttgctgtgcttctcgcggtc

SEQ ID NO: 42581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgcgttattgttacgggctaagtccgtc

SEQ ID NO: 42582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgctactttaggtcaagggaggtcggac

SEQ ID NO: 42583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgctgatgtattcggcttatccggccgg

SEQ ID NO: 42584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgctgtgtgttgcttctgttatgggcgt

SEQ ID NO: 42585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggaacgttgcaagccagagtgtttttg

SEQ ID NO: 42586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggacctgtatgtttttatttcgggatc

SEQ ID NO: 42587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggatgcatattatgtgctccaggctgc

SEQ ID NO: 42588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggctatccttcataccagtcaccgagc

SEQ ID NO: 42589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggggttcgagagggtttaagaatacct

SEQ ID NO: 42590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgggtgcgcttttagccattgtgcgcgc

SEQ ID NO: 42591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggtacgttcatcagcagagtacgcgtg

SEQ ID NO: 42592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggtcccgggcatgccaattcctatcgg

SEQ ID NO: 42593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggtgtaattatcgcttgtggcaaatca

SEQ ID NO: 42594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccggtttggcgcatcaaagaagtattgtt

SEQ ID NO: 42595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgtgatttcgctaagacacaaacacctt

SEQ ID NO: 42596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgtgcaccatcaccgagtgactgcaaga

SEQ ID NO: 42597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgtgcgacgagtaaggcccggttgggag

SEQ ID NO: 42598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgttcccctttcgtggtgcacgaactcg

SEQ ID NO: 42599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgttccgtccttgacaactgcagcatcg

SEQ ID NO: 42600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgttgcgtttattgacttgaactggctt

SEQ ID NO: 42601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccgttggttggtaaatgtaccacgctccc

SEQ ID NO: 42602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctacgcgaccgcaatgaatcgatcaacc

SEQ ID NO: 42603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctatatgatcctagcagactccttccga

SEQ ID NO: 42604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctcccatcgaagtagttctatgctagtc

SEQ ID NO: 42605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctcgccacctcggaacatctgtttttcg

SEQ ID NO: 42606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctctgccccgactgtagttgcggccgct

SEQ ID NO: 42607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctcttacctgcaaacggacacttctatt

SEQ ID NO: 42608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctcttccgctacaatcattcgtccttct

SEQ ID NO: 42609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctgcgataaggaaaggccgcgtcttgct

SEQ ID NO: 42610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctgcgtgttttaggttcgccgacaactt

SEQ ID NO: 42611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctggacggaatagtaacgggcatcttcg

SEQ ID NO: 42612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctggtttgcgcggggcgggtgctgacgg

SEQ ID NO: 42613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccttatgcgtagcagtatttatcgtcgaa

SEQ ID NO: 42614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccttcactgggtataccctttggggtcat

SEQ ID NO: 42615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccttgaagctgctaccgtgcgtgagggag

SEQ ID NO: 42616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccttgctcgacgggtatagcttgcgtact

SEQ ID NO: 42617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccttgggttatacgtgtaagcatagctgc

SEQ ID NO: 42618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccctttatggcgacgtgcccgaggtcatta

SEQ ID NO: 42619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccccttttccacgtaggggacgcgatccctc

SEQ ID NO: 42620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaacagcgcggagaggagtcgtatagtg

SEQ ID NO: 42621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaacatgccatccccggtgttacgaatt

SEQ ID NO: 42622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaacatgcgtacgatacgagatgctggc

SEQ ID NO: 42623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaacgataacttggtgggaatcagttga

SEQ ID NO: 42624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaactgatgcttggcggatcgaaatttg

SEQ ID NO: 42625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaactttaagactgccctttcctatcgc

SEQ ID NO: 42626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaactttgtgactctccatccctctgca

SEQ ID NO: 42627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaagatgatgcgaccaactcggttgcct

SEQ ID NO: 42628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaaggtgaccctgcaaggcgacgcattg

SEQ ID NO: 42629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaatacttcatcccgacgtcggacgtat

SEQ ID NO: 42630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgacatggttaggcaggtcgagtattccg

SEQ ID NO: 42631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgacgaagatagatgggagctggcgtttg

SEQ ID NO: 42632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgacgctctgttgggagattcgggtgggg

SEQ ID NO: 42633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgactagtctcctaatacagtaaggtcga

SEQ ID NO: 42634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagaagagagtggaacctaatacctacg

SEQ ID NO: 42635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagagcgtcacccggcctgccattcccg

SEQ ID NO: 42636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagatcgctgctttctgattcaggggtc

SEQ ID NO: 42637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagcacgaccgtttcaggccatcagtgg

SEQ ID NO: 42638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagcagataccgcatgagtttatgatca

SEQ ID NO: 42639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagccgcatgggaggttgtcgcagtcga

SEQ ID NO: 42640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgaggcgctgactgggtgaaggggtgtgc

SEQ ID NO: 42641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagtcaggaaccgcgtacgaatgtcctg

SEQ ID NO: 42642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagtcctaggccaacacttgggcgaccg

SEQ ID NO: 42643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgagtcgactgcccacagcttgcgctgtc

SEQ ID NO: 42644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatacgaggactgtgggcgatggggaca

SEQ ID NO: 42645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatcgggactttcggcttagctccgagg

SEQ ID NO: 42646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatcgtatcgctgagcatcacggtgtgg

SEQ ID NO: 42647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatgaacccaagcttcgcaattacaagt

SEQ ID NO: 42648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatgcctgaactgaaaactgtgtcgatg

SEQ ID NO: 42649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgattcacgctatgctccattatacggtc

SEQ ID NO: 42650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatttatacgtaacgtctcggatgcgtt

SEQ ID NO: 42651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgatttgatgttctgttatgtaagcgaaa

SEQ ID NO: 42652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcaatgttaaccccagtagatcggctct

SEQ ID NO: 42653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcacgtctcgccgattgcacatggatcc

SEQ ID NO: 42654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcagaggtctgaaccttagactccatat

SEQ ID NO: 42655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcagctttgtcccttacagtatatgcgc

SEQ ID NO: 42656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcagtcactgctatgaggcgttgtcggg

SEQ ID NO: 42657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcatataacacctttccaagtctgcgcg

SEQ ID NO: 42658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcatcaatcaccagtgggcgaagtaggg

SEQ ID NO: 42659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcatccgtcccatacgtcatccgttaga

SEQ ID NO: 42660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcattctccactctaggttcgttgggcc

SEQ ID NO: 42661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgccacggtgctcacgtcgaaatggcccg

SEQ ID NO: 42662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcccggattgtggctgcaccgtccgtgt

SEQ ID NO: 42663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgccggcttgtgtagacgcatcactcgag

SEQ ID NO: 42664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgccggggacgtgcgagtaagacgtcttt

SEQ ID NO: 42665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgccgtgccgagggcgtgagggcatcacg

SEQ ID NO: 42666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcctacctgttgactcacgctgcgcgat

SEQ ID NO: 42667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcctagtgttaacttcggaccacgagcg

SEQ ID NO: 42668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcctcgctcgttagctactgacatgaga

SEQ ID NO: 42669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcctgacgtagttcccccaagtccctgt

SEQ ID NO: 42670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgaaattgatcttggggctgccagtcg

SEQ ID NO: 42671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgaacactacgacggagaactgccatt

SEQ ID NO: 42672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgagttaacttgacttagtttgcgcat

SEQ ID NO: 42673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgctccgtttcaaggtgtgtgtttggg

SEQ ID NO: 42674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcggaggttacggctaggcttcgtgtag

SEQ ID NO: 42675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcggcgagcgaaacttggacgttccttg

SEQ ID NO: 42676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgtaccggaactagtgcccgatccatg

SEQ ID NO: 42677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgtacgccggaccgcttttggcattga

SEQ ID NO: 42678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgtagtccttgctcggcttaatgagtt

SEQ ID NO: 42679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgtcgcagcgttcgtgggaattgcttc

SEQ ID NO: 42680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgtgtacgcctggtagtaatgagccgc

SEQ ID NO: 42681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcgtgtgacagttcttggtgcgacagtt

SEQ ID NO: 42682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctaaaattgactgcacgatttgttcgc

SEQ ID NO: 42683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctacttcgataaatcatgtgtggtacc

SEQ ID NO: 42684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctatagttaatgcgctcatgttctcgg

SEQ ID NO: 42685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctatgacgagcgatgtacttgcgctcc

SEQ ID NO: 42686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctcgattgtgtgccgccgtgatgttgg

SEQ ID NO: 42687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctcggtgttctctgtcacccgtctacg

SEQ ID NO: 42688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctctgctagtaggaatgccactctgtc

SEQ ID NO: 42689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctgcatgcaccttcacggtccggtcca

SEQ ID NO: 42690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgctgtgcaattgtctttggatctacccg

SEQ ID NO: 42691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcttcgttgtcacatggggttattccgc

SEQ ID NO: 42692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgcttgtacacttcatacgttcgcagagc

SEQ ID NO: 42693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggaaaggtgcatttactggacgtaatgg

SEQ ID NO: 42694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggaactggtgagagggtggcaggcgtcg

SEQ ID NO: 42695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggacagatttccgctcctggattatttc

SEQ ID NO: 42696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggaccgagccaccgttttcctaacctgt

SEQ ID NO: 42697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggacgcgatcagttgtagcggattcgat

SEQ ID NO: 42698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggactctaaccttgccgcgggctctgtc

SEQ ID NO: 42699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggagatggtgttgcatatcagcaccacg

SEQ ID NO: 42700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggagcacgtactatgccacagaggaagc

SEQ ID NO: 42701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggagcgccaaggcctcattgctttgagc

SEQ ID NO: 42702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggatccagatatgttatttccgtctggc

SEQ ID NO: 42703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcaagacggcggtgatgatgcgccagt

SEQ ID NO: 42704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcatcacgtcacgtctgatttgtattg

SEQ ID NO: 42705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcctaatgggtttctcggtaacttagt

SEQ ID NO: 42706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcctcctaggcatggggtcatcgggat

SEQ ID NO: 42707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggccttgtacaggctaactctgccctgc

SEQ ID NO: 42708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcgatatcgtaggtcgggacacgcgaa

SEQ ID NO: 42709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcgcgctgcagcatgggaagccgggtg

SEQ ID NO: 42710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcgcgtaatgtgtctctaaggagttgt

SEQ ID NO: 42711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcgtcctggagccctgataggccatgc

SEQ ID NO: 42712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggcgtcgtgtagggtttacgcggtttgc

SEQ ID NO: 42713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggaaaattctttgggtattgctgcaac

SEQ ID NO: 42714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggaaaccagtttttgtctcactttgtt

SEQ ID NO: 42715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggagtacaaccagattgtatagccttc

SEQ ID NO: 42716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggatatggggaggcatgataggtcagc

SEQ ID NO: 42717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggatctcgactcatcctacgtttaggt

SEQ ID NO: 42718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggcatcaaaaggtctgggtttcgcgct

SEQ ID NO: 42719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggcggctttgcaaaggtgtcctgcctg

SEQ ID NO: 42720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggctgctgagcgctgtttttctgccat

SEQ ID NO: 42721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggtgcaacgcgggatttctctccaacc

SEQ ID NO: 42722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgggttaattccgtctccctcataaccgc

SEQ ID NO: 42723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggtagctagacttgccgtggtagtaaag

SEQ ID NO: 42724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggtccgcatcaaaggtaataatgtttaa

SEQ ID NO: 42725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggtccggcctgactcgtcactaacggtc

SEQ ID NO: 42726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggtctgcccattttcgatttcacccgcg

SEQ ID NO: 42727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggtctgttaggtgttcctcggatgcatg

SEQ ID NO: 42728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccggtgtcaacgatgcaacacacacactcc

SEQ ID NO: 42729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtacaccgctgtatgtggtctcgacctc

SEQ ID NO: 42730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtacgttacattgttctgctattaaagt

SEQ ID NO: 42731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtaggcttcagctccggtgcaactggct

SEQ ID NO: 42732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtattacgcgcggaataggtaacgatcg

SEQ ID NO: 42733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtattgagatagtcggccgccaagctca

SEQ ID NO: 42734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcacgctgctgtttatctgatcgccta

SEQ ID NO: 42735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcacgggtgtggcaatgcgaaatctta

SEQ ID NO: 42736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcacttttgctaactaggaggattagc

SEQ ID NO: 42737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcaggagagcaacttgcagccactttg

SEQ ID NO: 42738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcatagatgcgatacggcgcatcacac

SEQ ID NO: 42739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcatcgaaaattgctaccgcgatacta

SEQ ID NO: 42740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtcatctagagcgcgggacagcttcgtt

SEQ ID NO: 42741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtctcggctcgcatgatgcgcaagtgct

SEQ ID NO: 42742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgaagtcgtttcggtggcgtgctgtga

SEQ ID NO: 42743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgactactatcatggattggaagcata

SEQ ID NO: 42744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgatcccgttcctcacgaagtttgcca

SEQ ID NO: 42745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgcaattgtaaaggggttgtgcgaacg

SEQ ID NO: 42746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgcacaggtgttctttcgcatgcgggg

SEQ ID NO: 42747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgcatcacatttactatctcgatccgt

SEQ ID NO: 42748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgccatgttagtcaggctcccgacatg

SEQ ID NO: 42749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtggcaatgcgggataaagcaagggggc

SEQ ID NO: 42750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgtctaccggacaaaacgattctgctg

SEQ ID NO: 42751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtgtgctagctgattcaaccgacatgtc

SEQ ID NO: 42752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttagttgtttcacggcgttcattccgc

SEQ ID NO: 42753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttcataacagcccctctcgcggtcgtt

SEQ ID NO: 42754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttccaaacgcgccaggtgtcccttctt

SEQ ID NO: 42755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttcgcttacagccacgcgccggcaaga

SEQ ID NO: 42756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttcggctttgacaggcgatgggcgaga

SEQ ID NO: 42757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttgagttatattgtcggggctacgggt

SEQ ID NO: 42758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttgtaagtggatgcattgagccaacac

SEQ ID NO: 42759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgttgttgtctgttcctcggtggtcaagg

SEQ ID NO: 42760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccgtttttttcccggcagcacgtgggagtt

SEQ ID NO: 42761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctaaaccagctttcgtgtgctgagcggtg

SEQ ID NO: 42762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctaaggtcacaggtgagggcgacaaacgc

SEQ ID NO: 42763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctaatactcaccgtttagaacgttgatgc

SEQ ID NO: 42764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctacgcgaagtggaggtcgttcttcattc

SEQ ID NO: 42765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctactgacgaggcgagaaaccgaggactc

SEQ ID NO: 42766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctagactgcgcactgtttatcaggctcca

SEQ ID NO: 42767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctagcaactgccaactcaggacgtgattg

SEQ ID NO: 42768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctagttgccggactatctagtttcccgac

SEQ ID NO: 42769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctatgggtggcgcaaggtctgcgacgttg

SEQ ID NO: 42770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcagccagtaccgtcttcttggacatgg

SEQ ID NO: 42771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcatcgtcggtccaagtgctacatcctc

SEQ ID NO: 42772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcatggaaacatccagcgtgtgccagac

SEQ ID NO: 42773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctccctctacgcctgtgtgcgtgtaaatg

SEQ ID NO: 42774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctccgcagcgtcaacccggttgcattgtg

SEQ ID NO: 42775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctccgcagtgagaatcgtcgagtgcggct

SEQ ID NO: 42776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctccggtttccggccgagcaactgggctg

SEQ ID NO: 42777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcgcgaatgctaagctcttcgggacctc

SEQ ID NO: 42778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcggcgactgatgaatcttgggccgatt

SEQ ID NO: 42779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcggctactccagatcgggtttggtggt

SEQ ID NO: 42780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcgtactttcgtcaatcgatctgtcgtg

SEQ ID NO: 42781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcgtagtacttcttctctacggaatata

SEQ ID NO: 42782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcgtggtagttacagtgaccggtattgt

SEQ ID NO: 42783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctctccatacctaacgcggtgtgttcccc

SEQ ID NO: 42784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctctcgcacagttggcgcattggagggtt

SEQ ID NO: 42785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctctctccggggtagcattaagaaggaac

SEQ ID NO: 42786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctctgcgcttagttaccaagctctccact

SEQ ID NO: 42787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctcttataaccggtagcacctggattatg

SEQ ID NO: 42788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgaaggtgagcgcgacatttttctggca

SEQ ID NO: 42789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgaataaatcctcttgagggaggcacac

SEQ ID NO: 42790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgacaccccggggcttatgtaacggcgg

SEQ ID NO: 42791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgacgtgatatggcgcggtccccacgcg

SEQ ID NO: 42792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgagtcagaagccgatcattgcgccgtc

SEQ ID NO: 42793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgcaaaagccgcaacctacgggtccgcg

SEQ ID NO: 42794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgcaacggggaattcggtcatgacaaac

SEQ ID NO: 42795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgcatcgagcggtaagctatctagtgca

SEQ ID NO: 42796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgcgaatctaaagcgaaagtgggtaaca

SEQ ID NO: 42797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgcgacgctatccgtgccccctcgtgtt

SEQ ID NO: 42798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgcgaggattccgctggttaaacagtgg

SEQ ID NO: 42799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgctaaaggactcgggtctgcttagctc

SEQ ID NO: 42800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgctacgccggcgcatcagaattccatg

SEQ ID NO: 42801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgctgcgattctagtgccactacttcgt

SEQ ID NO: 42802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgctggtgctgtggcctgcagatcgtta

SEQ ID NO: 42803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctggagctaggattccggtgttctcctcg

SEQ ID NO: 42804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctggcagtagggggagatcagcatcagtg

SEQ ID NO: 42805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctggggatgggttcgattatcttgcacca

SEQ ID NO: 42806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgggtgttctgcggtgcgtgacggcgac

SEQ ID NO: 42807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgtaaccgcgttgcttcgatttacatca

SEQ ID NO: 42808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgtagagctgggatccattgtcaacgtg

SEQ ID NO: 42809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgtgccctggcgtacaggcgacgggtcg

SEQ ID NO: 42810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgttatttccgcactgccacgtctctcg

SEQ ID NO: 42811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctgttgtacgagcaagtggggcgcaacct

SEQ ID NO: 42812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttacccattttgcccggttctcctgtcg

SEQ ID NO: 42813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttacggtaagccactatacagggcaggt

SEQ ID NO: 42814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttatcgatacggacacgaaatttagccg

SEQ ID NO: 42815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttatctgtttccggcacaattccctacc

SEQ ID NO: 42816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttccagcagtgaggctgggtcagcgttc

SEQ ID NO: 42817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttccgcaacacatagcttggcgtcgctt

SEQ ID NO: 42818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttccttatgactgctgcgtcggccatcg

SEQ ID NO: 42819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttcgtttgaatcaggactatgtacctcg

SEQ ID NO: 42820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttctagatcccccatgtgagcagaacgg

SEQ ID NO: 42821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttcttatctttttaccgacggcatcgga

SEQ ID NO: 42822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttgacgcgtgtcatcttcagttaccggt

SEQ ID NO: 42823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttgatcctctcagtgtcacgattgggcc

SEQ ID NO: 42824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttgccaattcactacctcgtctccgggg

SEQ ID NO: 42825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttgcctacgatgtatactgtagcggtgc

SEQ ID NO: 42826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttggatagagtagcgagttgccatcaca

SEQ ID NO: 42827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctttaatcactaccactcaagctactctt

SEQ ID NO: 42828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctttactaatcagattctcgtgtccgtga

SEQ ID NO: 42829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctttccttgctcgcctagtgtccgcgctt

SEQ ID NO: 42830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccctttgctcgttcgccccgattcatccccg

SEQ ID NO: 42831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcccttttgaaattccaaatccccgcacggtt

SEQ ID NO: 42832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaacagctccccagccagagccacagtg

SEQ ID NO: 42833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaacgacgtcagatgaacatttagtaca

SEQ ID NO: 42834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaactgctggccaaggtcaggagtctta

SEQ ID NO: 42835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaagcggtcgacctaggtttttgcgtgc

SEQ ID NO: 42836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaatcgcttctgggtttgctattaactt

SEQ ID NO: 42837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaattactgcgtgtgatcgatctcgtac

SEQ ID NO: 42838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaacaaatccattctggtactctggatgc

SEQ ID NO: 42839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaacatcgggcattcactccttgtttcta

SEQ ID NO: 42840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaccatcaagccatctcgtttttctctc

SEQ ID NO: 42841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaacccagtcaacaggcggtccacggtcg

SEQ ID NO: 42842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaccttaacttcgtctttgatccacgcg

SEQ ID NO: 42843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaccttggggaatatgcgtattcgggat

SEQ ID NO: 42844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaacgctttccggtacacttgtgtgtcga

SEQ ID NO: 42845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaacggttggtctgtctacaccggtgtcc

SEQ ID NO: 42846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaactatagaaacttggatcgggtgtcaa

SEQ ID NO: 42847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagaccgcaccaaaacgaacactttctg

SEQ ID NO: 42848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagaggctcactctgtggtttattgagg

SEQ ID NO: 42849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagatcaagcatagatcagcgcgtggca

SEQ ID NO: 42850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagcaggaggcgggcgtttaactttcct

SEQ ID NO: 42851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagccgtaaagaacattaaagggtttgg

SEQ ID NO: 42852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaggagtccgtagcgtcgccgtgccact

SEQ ID NO: 42853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagggggattccatggtttggggcaatt

SEQ ID NO: 42854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaaggtttgtgtttcggggtggctcgggc

SEQ ID NO: 42855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagtaaagagtgtcgagtaacttcctcc

SEQ ID NO: 42856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagttgggcaaagtgtatcgccacgatt

SEQ ID NO: 42857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaagtttagtattgagaacgtgtgcaggc

SEQ ID NO: 42858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaataacggggagtgggaagccggctgcc

SEQ ID NO: 42859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatagtcatgatgcaactggggtaggag

SEQ ID NO: 42860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatagttttcgcgctcctggctagggtc

SEQ ID NO: 42861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatcaggcttacgggtaacaggcgcagg

SEQ ID NO: 42862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatcatttggtagatgacttgaatattg

SEQ ID NO: 42863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatgcagctctttgatttacaggagaag

SEQ ID NO: 42864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatgcgaatcagaatatttgccgttgcc

SEQ ID NO: 42865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaattccgtcagttctaatctgttcgagc

SEQ ID NO: 42866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaattggtgcgtttcccaccacgtgagat

SEQ ID NO: 42867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaatttggatgcgggcgcaagtttcattg

SEQ ID NO: 42868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacaactccatttggaaagccacgtttca

SEQ ID NO: 42869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacacggggggagccgtctccttgtctac

SEQ ID NO: 42870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacagtccccgaactctcctggagatgct

SEQ ID NO: 42871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacatacaccacctaatttccgcgttagg

SEQ ID NO: 42872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacatcacctagccgcctttattggcctc

SEQ ID NO: 42873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacatgagttcgggatatcagaattgctt

SEQ ID NO: 42874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacccaaagggtacgaggttgactgcaac

SEQ ID NO: 42875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaccccacaccggttcatgctcactgggc

SEQ ID NO: 42876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacccctgtcctagtagtcggagggttcc

SEQ ID NO: 42877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaccgcatggctgacaagtgaggaagttt

SEQ ID NO: 42878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaccgtcgtgtgtctatgctcctacccta

SEQ ID NO: 42879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacctcgagcgaaatccacctcttgcttc

SEQ ID NO: 42880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacctgcggtaaagtattcgatggcgcaa

SEQ ID NO: 42881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaccttgggcctgttccggtggtggttag

SEQ ID NO: 42882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaccttgggtattactggccctaactaga

SEQ ID NO: 42883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgacttaggaattgaagctttgcggtc

SEQ ID NO: 42884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgaggagtgccgttagctgcttcccct

SEQ ID NO: 42885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgagggtgccaggcggctgcgtattgg

SEQ ID NO: 42886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgcacacatgcatgtttgggaacgctc

SEQ ID NO: 42887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgccggtgcggaactgaacgttgactg

SEQ ID NO: 42888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgcgacgccgatatcgacagcctgttg

SEQ ID NO: 42889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgctgctgttgcttggctgttttcggc

SEQ ID NO: 42890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacggagtcccacgcgtgtgatatgtgcg

SEQ ID NO: 42891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacggcgtgcgatgtgaaacgactggccg

SEQ ID NO: 42892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacggtttgacctcggttcatgagtagat

SEQ ID NO: 42893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacgtagttgtgaatgcggagaactgagg

SEQ ID NO: 42894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgactacggttagtgcgggtggcatggatg

SEQ ID NO: 42895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgactagcgtaagccgcgatgcagtcgatg

SEQ ID NO: 42896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgactctcacttctgccactagtaggtacc

SEQ ID NO: 42897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgactgaactccagggcggtacggatacta

SEQ ID NO: 42898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgactgtctatcggttacctttcgggtaca

SEQ ID NO: 42899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgacttggaggtggctactaaacgacgcga

SEQ ID NO: 42900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagaaccctgggggctgcagtctccgcgg

SEQ ID NO: 42901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagaacgtgaaggtgaggcttccctgcga

SEQ ID NO: 42902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagagtttaacccgttagcgcagcctgta

SEQ ID NO: 42903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcaacgggaacaaaggaaccggcagag

SEQ ID NO: 42904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcactcctgcgatgtgaccgggccgtc

SEQ ID NO: 42905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcagagcacaaagggcaaggttatttg

SEQ ID NO: 42906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcaggacctcaagttggcttgtgtggg

SEQ ID NO: 42907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagccacggtactttcacctgtgcgccac

SEQ ID NO: 42908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcgatggtaggttggcatttgtcttgt

SEQ ID NO: 42909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcgattccctcctagacctgttacgag

SEQ ID NO: 42910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcgcagaacgtggcgtgttacacagtg

SEQ ID NO: 42911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcggcagtataccacgttaatgcagtg

SEQ ID NO: 42912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcggttcgtttattttgggctaacttg

SEQ ID NO: 42913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcgtccgagcacgaacacggcgtcgta

SEQ ID NO: 42914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagctcattctatcacgttgacccccgtc

SEQ ID NO: 42915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagcttcctagttttgcatagccagagtg

SEQ ID NO: 42916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggaccagttatggtcattccagatatt

SEQ ID NO: 42917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggacgagcatgtggcatccgtctttgt

SEQ ID NO: 42918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggagtgggcatactcggattcacgcac

SEQ ID NO: 42919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggagttgggccgctttcatgtggctat

SEQ ID NO: 42920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggcagttgtgctccgttgcgttctcgc

SEQ ID NO: 42921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggccgacgcgcgggctggataggcact

SEQ ID NO: 42922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagggacatagacgaggtttgcttggctt

SEQ ID NO: 42923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagggaccgccttcagttgtcggtgtctg

SEQ ID NO: 42924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagggccacagtgtgccgtgtgtggggcc

SEQ ID NO: 42925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagggctgcgtcgcaaaggcatcaaattt

SEQ ID NO: 42926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagggtacctcgatgaggcggtttgaatg

SEQ ID NO: 42927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagggtgcctagcgttacgtaccaggccg

SEQ ID NO: 42928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggtcagaattgtaaatagaagggcaca

SEQ ID NO: 42929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggtctaaccttgcgatcctgttcttag

SEQ ID NO: 42930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggtgagcggacgcctcagtcccctcct

SEQ ID NO: 42931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgaggttcgtaaccggctcaacgacaaatt

SEQ ID NO: 42932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtaaggttcaagtgtttcccattttta

SEQ ID NO: 42933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtctaggcacctattgaaataattttg

SEQ ID NO: 42934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtctcggattcactgtgggccaaagtg

SEQ ID NO: 42935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtgataatacttcccggcattgtaacg

SEQ ID NO: 42936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtggacgatgaatgcttgcctggccta

SEQ ID NO: 42937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtggtcagtgtagctctcgctgtggtt

SEQ ID NO: 42938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtgtagacataaaagaaagacgtctag

SEQ ID NO: 42939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgagtgttgtgcatgaggtggaaagcagcc

SEQ ID NO: 42940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgataaatccaccgggtgctgctgccgcat

SEQ ID NO: 42941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgataccgcatggtcaccggcgcttgacaa

SEQ ID NO: 42942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatacctgtagagggagccttgtctgcgt

SEQ ID NO: 42943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatacctgtggcctcaccctgtgttgtgc

SEQ ID NO: 42944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgataggcagattgactggtacgtacttga

SEQ ID NO: 42945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatatggcactcatgcagaaggtaagacg

SEQ ID NO: 42946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatcgcgcgggagcatgcagtactggctc

SEQ ID NO: 42947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatcttatcccactctactctgcactttg

SEQ ID NO: 42948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatcttcgttgcggggcctttcgcgtcgt

SEQ ID NO: 42949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatgatataggtatcagggtgtggcgggc

SEQ ID NO: 42950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatgcagaccgcggggggactcggtgagc

SEQ ID NO: 42951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatggaggtcgccttagggttccggggcg

SEQ ID NO: 42952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatggagtaacagcctcaatatgactagc

SEQ ID NO: 42953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatgggaggacgatttgagtgacgacagc

SEQ ID NO: 42954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatggtatagtggtatccgggaacacgct

SEQ ID NO: 42955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatggtgactctgctgaaatgttagtact

SEQ ID NO: 42956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatgtactgaaattaggggaataatgatt

SEQ ID NO: 42957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatgtcgtgcgagggagtagccggtcttc

SEQ ID NO: 42958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatgtgagtagttggcagttccggagtaa

SEQ ID NO: 42959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattaaaatgggagtttggcggccgctcc

SEQ ID NO: 42960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattaccgcgtcgatcgtaactaagcgat

SEQ ID NO: 42961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattcagcgccgagacatcaccgtgcggg

SEQ ID NO: 42962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattcctcgacaaccctctagcggttgga

SEQ ID NO: 42963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattctattcgttcatcatctggggttca

SEQ ID NO: 42964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattctcagagctcatggcagggccgacg

SEQ ID NO: 42965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattgcgaaattgacagcagtgtcgcgta

SEQ ID NO: 42966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattgctcttgttgcgttctgcgtcgtaa

SEQ ID NO: 42967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattgctgggcattcccaagtgtggagcc

SEQ ID NO: 42968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattggctcttcatcactggcccggtccg

SEQ ID NO: 42969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgatttggcgtagtgaatatgtttttgtca

SEQ ID NO: 42970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgattttgacggattcatttttgtagacac

SEQ ID NO: 42971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaaacgctttgcttagccgtctactgtg

SEQ ID NO: 42972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaacaccgacgggtactacggctcggtt

SEQ ID NO: 42973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaacatgtgtgccgtgttttggctgccg

SEQ ID NO: 42974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaaccacgttcacacagtcctcgaacgg

SEQ ID NO: 42975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaacgaagctaccactgcactgtggctt

SEQ ID NO: 42976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaacggtggatgggctggagtacccctg

SEQ ID NO: 42977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaagagaatcgcagatagcatcgtgtgg

SEQ ID NO: 42978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaaggtagtcaatatggcgcgcaggcaa

SEQ ID NO: 42979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaattacttcgttgagttggctctcata

SEQ ID NO: 42980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacaaaccgtgcgttttggtaccgttgg

SEQ ID NO: 42981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacaagggattcatcactattggtccgt

SEQ ID NO: 42982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacaatggcatttcgttgcggttgctga

SEQ ID NO: 42983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacaattcccttgctaggtgaatgcaat

SEQ ID NO: 42984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaccaattcgcggcttgcgcggtcccca

SEQ ID NO: 42985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacccactgccttacgcagcgataagga

SEQ ID NO: 42986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaccgtagagtacaagttctgatggaca

SEQ ID NO: 42987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaccgtaggataacccaacctcggcgtc

SEQ ID NO: 42988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacgaactacctgatcgccattctgggg

SEQ ID NO: 42989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacgacaatccgcctcacagttccgtgg

SEQ ID NO: 42990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacgagctctgtgcgtggaggaaccgct

SEQ ID NO: 42991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacgcaggtgaaggacccggtgttcggg

SEQ ID NO: 42992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacgtacgtaaggaagaggactgttggc

SEQ ID NO: 42993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacgtgtccttgcttgggaagcaactga

SEQ ID NO: 42994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcacttgctctccccggcgctttcgaccg

SEQ ID NO: 42995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagaaacagactaagaggcgacttaccg

SEQ ID NO: 42996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagagacatccgtcggagattactcgtc

SEQ ID NO: 42997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagagagactcccaaaccccgagccccg

SEQ ID NO: 42998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagagagcccaaggcgcatccgtattca

SEQ ID NO: 42999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagataggaaattgaatgcgcgtatgcc

SEQ ID NO: 43000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagcagatttacctaaccaccaccgcca

SEQ ID NO: 43001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagcccatctgcaggcaaagtcggtcat

SEQ ID NO: 43002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagctattgagacatacgtatgcgcagt

SEQ ID NO: 43003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagcttcagggattgacctttccgcttt

SEQ ID NO: 43004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcaggatacgtcgtgacgtggacgcgccg

SEQ ID NO: 43005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagggtaacccttgacgtacggtatccc

SEQ ID NO: 43006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagtaatagggcaacaaccctacgctac

SEQ ID NO: 43007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagtcttcgtatccatgtacggcgcatg

SEQ ID NO: 43008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagtgatttcaagccgagtgatgacaat

SEQ ID NO: 43009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagtggtgggttctgagttaattgacgg

SEQ ID NO: 43010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagttgacgaacagtagacaaggcatga

SEQ ID NO: 43011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcagttgactcaaacatcaccgtacttgc

SEQ ID NO: 43012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcataaacctggcgatcggatcaattagg

SEQ ID NO: 43013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcataagacggttcaggcacggtgtagga

SEQ ID NO: 43014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcataaggtcgaggatcttgttccgcggt

SEQ ID NO: 43015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcatagttaggattcgtatttggacctag

SEQ ID NO: 43016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcatcatgcgtagaggaagtccggcttca

SEQ ID NO: 43017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcatcgggtgtgatattcgtctgcgaggg

SEQ ID NO: 43018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcatggaggtgaatagccggggataatcg

SEQ ID NO: 43019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcatgtctggccaggccgtgtgatgtgta

SEQ ID NO: 43020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcattgatgttgcatatggccttagttgc

SEQ ID NO: 43021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcattggaagtaaccgaattcgctggaga

SEQ ID NO: 43022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccaaaactttccaagcgactgttctgtg

SEQ ID NO: 43023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccaacaggttgagtaaatgcattgcctg

SEQ ID NO: 43024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccaacgtttagtagcgcttctactgttc

SEQ ID NO: 43025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccacaactcactgtctgtcctatccgac

SEQ ID NO: 43026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccaccgagcctaacattcatccaccgtg

SEQ ID NO: 43027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccagaacgaacatagagtgttgtcagtg

SEQ ID NO: 43028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccagaacggaattcggggaactttgacg

SEQ ID NO: 43029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccagcacattacttgacccgtatctgga

SEQ ID NO: 43030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccatgtcaacccagttgtccagctaccg

SEQ ID NO: 43031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccattaatttcgcgttctgtctcatact

SEQ ID NO: 43032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccattatcatgttgtctgggtgacggcg

SEQ ID NO: 43033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccattgggtgagaatgcaaattaggtag

SEQ ID NO: 43034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccaagaagcatttttcttcactgcata

SEQ ID NO: 43035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccaagcgattgagtagctttcggctag

SEQ ID NO: 43036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccaatcttagacaatctgttttcatgc

SEQ ID NO: 43037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccaccttactcgaggtccccgttcgct

SEQ ID NO: 43038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccagtggtaggatgcttgatagcgcgg

SEQ ID NO: 43039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccccagtatcccttgcttgctgtcacgc

SEQ ID NO: 43040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccccatccttagccacacacgtccggcg

SEQ ID NO: 43041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccccagcctctttgtgaacctgcattc

SEQ ID NO: 43042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccccggggtttagactgcagcacaggac

SEQ ID NO: 43043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccccgtatactgcgaagctggcatcgga

SEQ ID NO: 43044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccccgtgcatgactgcaactccttacgc

SEQ ID NO: 43045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccgacgatccggcgaacttaagcacgc

SEQ ID NO: 43046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccgagcaaatgatggcctggtttgcca

SEQ ID NO: 43047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccgcaggtgtggttcaacggaacgtgg

SEQ ID NO: 43048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccgcatccactacctgtctatacgtcc

SEQ ID NO: 43049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccggagataagccgtctcccgttcttg

SEQ ID NO: 43050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccggagcaagtttctgcattatggttt

SEQ ID NO: 43051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccgtgttgcagcataggggtttggtag

SEQ ID NO: 43052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccctaccgtggggacgtttatagggatg

SEQ ID NO: 43053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcccttgggattttcatcggtggtagccg

SEQ ID NO: 43054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccctttcatcgcatccaagacccaccgc

SEQ ID NO: 43055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgaaatcgcgtccagcttgtgccgaaa

SEQ ID NO: 43056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgacggtcctaggttgatcgtgacata

SEQ ID NO: 43057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgagggatcttggggcgagtgtacggt

SEQ ID NO: 43058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgatgttgtaccatttccaggtgtctt

SEQ ID NO: 43059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgcatgagctatctcgataggggcacg

SEQ ID NO: 43060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgcgacattaatctagtgttcctggct

SEQ ID NO: 43061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgctagagggtcatcttacattgatgt

SEQ ID NO: 43062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgctctctgcatttgtttcctgaacca

SEQ ID NO: 43063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgctgcatcgtacatggattgctcatg

SEQ ID NO: 43064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccggagccatccgggaacatgtcatttt

SEQ ID NO: 43065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgggaacgctaagtgcacgggaagctg

SEQ ID NO: 43066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgggactgcggagctggttcgtgcatg

SEQ ID NO: 43067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgggcatcgtctgaacggtcctcgtgc

SEQ ID NO: 43068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccggggattacctctcagcttgtcccga

SEQ ID NO: 43069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccggttgcttggtactcgggggcagagc

SEQ ID NO: 43070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgtggagggtctcacacgctccccgag

SEQ ID NO: 43071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgtgggtacgagatggagtggatagct

SEQ ID NO: 43072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccgtgttttaagtcgtggtactgcgtgg

SEQ ID NO: 43073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctaacatatggataacgggggtacttg

SEQ ID NO: 43074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctaatattattctagaccggagcgacg

SEQ ID NO: 43075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctagccccaggtagagcttgtatgagg

SEQ ID NO: 43076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctagggcgtgttctactgtcctgcgta

SEQ ID NO: 43077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctagggggttagctatcgggtcctaga

SEQ ID NO: 43078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctcaaggaggacccttagcatcttcgg

SEQ ID NO: 43079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctcggggctaggtttgcgataatactt

SEQ ID NO: 43080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctgtctaaaacgtggttcagttaatct

SEQ ID NO: 43081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctgtgaaagaacgttgttgcttttatt

SEQ ID NO: 43082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctgtgattcctaggatagcctgcaatg

SEQ ID NO: 43083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccttgatcagctgagggtcggttgtgca

SEQ ID NO: 43084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgccttggccaaatgatggtggacggccta

SEQ ID NO: 43085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcctttcgtggttatatgtacctaacact

SEQ ID NO: 43086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgactgacgaatggcgtgaagatgtcgg

SEQ ID NO: 43087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgactgtcgttttcgcccacatgccgtg

SEQ ID NO: 43088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgagacaatgttccggtagggagggtca

SEQ ID NO: 43089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgagaggtgcgcagttcgggcttgtggc

SEQ ID NO: 43090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgagatacaccggaataagtgatgttaa

SEQ ID NO: 43091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgagtggaaaagcggattcttttacgca

SEQ ID NO: 43092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgagtttgaatgtcgccgaggttgcata

SEQ ID NO: 43093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgatggagtggcgtgatcccttatccgg

SEQ ID NO: 43094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcacctatttatcacgtgtgtgccgtt

SEQ ID NO: 43095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcatctgggctgtgcataccggtggct

SEQ ID NO: 43096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgccaggtttccacatctggagttcgcc

SEQ ID NO: 43097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgccattcgcatgcacccaatgccttcc

SEQ ID NO: 43098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcctgatctactacatggtgtaaatat

SEQ ID NO: 43099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcgacgtaatgcatctgggggtgcggg

SEQ ID NO: 43100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcgagattgcacatcgaacttatgggt

SEQ ID NO: 43101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcgccattcgttgcttcacgggaaacg

SEQ ID NO: 43102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcgcttgttggcatggggaaatggtgg

SEQ ID NO: 43103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcggattgagcacagcaaacagagtac

SEQ ID NO: 43104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgctcctccccagtgttcatcaaggatg

SEQ ID NO: 43105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgctccttggtttctatggtatactttt

SEQ ID NO: 43106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgcttccagtctatgcgtcgtcgttctt

SEQ ID NO: 43107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggaaagtgggacttggaccacgtgtag

SEQ ID NO: 43108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggaagatacgcagcacgcctgtttgcg

SEQ ID NO: 43109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggattgaatacgccattggtcgagaag

SEQ ID NO: 43110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggcgaatccgggtaactgtaatggtgc

SEQ ID NO: 43111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggcgacacccttactctctccactgcg

SEQ ID NO: 43112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggcgtctgggtcaaagaggaggtggtg

SEQ ID NO: 43113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggctgaaatggcaacttagaggctcga

SEQ ID NO: 43114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgggactctgttctcaatatggtcccta

SEQ ID NO: 43115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgggagtagggttggattgagtcgcctg

SEQ ID NO: 43116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgggattaaggtttcgctgttatgacgt

SEQ ID NO: 43117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggggagtatcggagcatgcaggcagcg

SEQ ID NO: 43118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggggtccttggatgtgttatcagtgcg

SEQ ID NO: 43119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggtagattctcgtcactagctccacga

SEQ ID NO: 43120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggtctagatccacaggtgcggtgcagc

SEQ ID NO: 43121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggtgagacactagtgaagagcgttagg

SEQ ID NO: 43122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcggttccacgtatgaggttgggccaccg

SEQ ID NO: 43123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtaaatgggcaggatgtttgactttgc

SEQ ID NO: 43124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtaccccccgaggtaggcaacctttgg

SEQ ID NO: 43125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtacgtaatgcggaatagtccggtggc

SEQ ID NO: 43126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtactcgttaactgcacattcacctcg

SEQ ID NO: 43127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtagaatcctgattgactgtggtgcca

SEQ ID NO: 43128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtatggaatgagcgtcggtcgatccta

SEQ ID NO: 43129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtcacttcttccacgagtcggttcatg

SEQ ID NO: 43130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtcagagcccctacgcgccgtcactca

SEQ ID NO: 43131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtccagagctcccaaattcgaacaaag

SEQ ID NO: 43132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtgacgcaacacagaaccgccgtactt

SEQ ID NO: 43133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtgcgtgtaattagtttgttgttaacg

SEQ ID NO: 43134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtgcttgagctctttctggcgtaccgg

SEQ ID NO: 43135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtgcttgcatactgcaacgacaattac

SEQ ID NO: 43136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgtgtctaactggtacccaatgatcgtc

SEQ ID NO: 43137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgttaaaccatcagggggaatcatggtt

SEQ ID NO: 43138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcgttgcatatttgcattcggtatcggtt

SEQ ID NO: 43139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctaacttgcacctctttcgcgggatccc

SEQ ID NO: 43140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctacaaaggaggtgacccaccgtgcacg

SEQ ID NO: 43141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctacatttcggtttaccaatgaggccgt

SEQ ID NO: 43142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctacccagctcggttcttggacctaccc

SEQ ID NO: 43143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctaccggagactattgcatctgtggcgc

SEQ ID NO: 43144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctagtggaaattgtaagtgccccgaggc

SEQ ID NO: 43145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctatgatcatggtgttgctgttagctgc

SEQ ID NO: 43146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctattataggtgaacccattgttatcgg

SEQ ID NO: 43147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctattccagaggagaggattgcgatatg

SEQ ID NO: 43148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctcaggcttccattcccggaccgggtgt

SEQ ID NO: 43149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctcatgagagtcaccttcgtttatgacc

SEQ ID NO: 43150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctcccaaccgaactcagccggtcaacac

SEQ ID NO: 43151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctcgggtcattggtaggaacgtccgtgg

SEQ ID NO: 43152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctcgttttacgttgggaagtgtaacgat

SEQ ID NO: 43153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctctgaaaagtgtcgtacctgaaatgtc

SEQ ID NO: 43154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgaggcacgtactgtcggttaacggcg

SEQ ID NO: 43155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgaggggagagaataggcttaaagtcg

SEQ ID NO: 43156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgcatataatatttgccctccgtatgc

SEQ ID NO: 43157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgcattcttgtgcttgggcttgctagg

SEQ ID NO: 43158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgcgaacgcgtgattccgtctcgtttg

SEQ ID NO: 43159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgcgcgtactccctcgatacggtgcta

SEQ ID NO: 43160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctggaatgaatgcagtcctgccaattgc

SEQ ID NO: 43161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctggccaccttgtgcattggtcgtcctg

SEQ ID NO: 43162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctggtgctaccgagcaacaaacagtgtg

SEQ ID NO: 43163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctggtttatgctcggggatggctgcatc

SEQ ID NO: 43164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctgttgatactgggtgcgttgacggctc

SEQ ID NO: 43165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcttacctcctcgctggtgtacgtgtgta

SEQ ID NO: 43166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgcttgaaggggataacacttatgtagcta

SEQ ID NO: 43167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctttatacgtcttggagtacgtttatgc

SEQ ID NO: 43168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctttcccatctcttctattaatcgtctt

SEQ ID NO: 43169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgctttctggggttccggggggtccacagg

SEQ ID NO: 43170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaacattctctgaaccgctctcaatgga

SEQ ID NO: 43171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaacgcgctcgaacccccgtgctggaag

SEQ ID NO: 43172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaacggtgcaagcgtagtcaacgacaca

SEQ ID NO: 43173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaactgtcaggaactacggtttgttatg

SEQ ID NO: 43174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacaaaaactgacaatagtatagacggt

SEQ ID NO: 43175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacaaagtaggcctctttaaggctctct

SEQ ID NO: 43176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacaagccaggggtcagcggatatgaac

SEQ ID NO: 43177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacaccgtgggacgacatgccgcttgga

SEQ ID NO: 43178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacatctggcccggggtgcaggtccgcc

SEQ ID NO: 43179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacattctctaaataacgtggcgtccgg

SEQ ID NO: 43180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaccaacgtttatgattttttccgacca

SEQ ID NO: 43181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaccgagtggaatttgtctgaatcttga

SEQ ID NO: 43182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaccgagttcttcatatgcgggtatatg

SEQ ID NO: 43183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaccgcctctacagttcgttcagcctgt

SEQ ID NO: 43184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaccggacgtctcgcattaggccagctc

SEQ ID NO: 43185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacctgattctgcaggcgagtcatattc

SEQ ID NO: 43186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacgccaaattgcgcaatgttgagttat

SEQ ID NO: 43187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacgggttaaagaatccgcgttgaaagg

SEQ ID NO: 43188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggactcgggaggaaaacacacggtaggct

SEQ ID NO: 43189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggactgatccacggggtgcctcatcggcc

SEQ ID NO: 43190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggacttgctccaattcagtctcgacgggg

SEQ ID NO: 43191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagaaagtgaggttttctgtcaatcagg

SEQ ID NO: 43192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagaaatctgagtgcccactcttgtgga

SEQ ID NO: 43193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagatattagacatgtgattaacgtgga

SEQ ID NO: 43194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagattccgcaacaggtaccttagccgt

SEQ ID NO: 43195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagcgacggtgctaaagatgctactcga

SEQ ID NO: 43196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagcgacttttgatgcagttcatttctc

SEQ ID NO: 43197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaggaacgtatgccacccacgcgtctcg

SEQ ID NO: 43198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaggaatcgaccggtcaataccagctgt

SEQ ID NO: 43199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggaggcgagacttaactcgtgtctcggac

SEQ ID NO: 43200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagtacttcatctttacacttactcctt

SEQ ID NO: 43201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagtcttggcgttttgtcgtggaaccgt

SEQ ID NO: 43202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggagtgtgggaggtgtgcgcgaagggagt

SEQ ID NO: 43203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggatcggtcgtatggagtccacgcgtcca

SEQ ID NO: 43204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggatgcgccgctccgtatacgacgcacgt

SEQ ID NO: 43205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggatggggcctacaagttctaacactccg

SEQ ID NO: 43206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggatgttgaggctcatctgggttaccaag

SEQ ID NO: 43207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcaaaacgtctctcgtgcttgtaatggt

SEQ ID NO: 43208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcaacccaagccatacgatgcccacacc

SEQ ID NO: 43209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcaacttctgacgtgtactgtgccggtg

SEQ ID NO: 43210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcaatctattttcgccgcggagagtaac

SEQ ID NO: 43211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcaatgggggagcgagttacaatatctc

SEQ ID NO: 43212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcacaggtgacgttcgtacacagcatgt

SEQ ID NO: 43213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcacctaagtggtacgatcaacctgggg

SEQ ID NO: 43214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcacggcattcgacagttgtagtttgcg

SEQ ID NO: 43215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcacggtgacacggtacgtaagagcacg

SEQ ID NO: 43216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcactccagagtattctttaaacaacac

SEQ ID NO: 43217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcagactagacgcggttgggctcacgtt

SEQ ID NO: 43218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcagatacaccattactcacaacgacga

SEQ ID NO: 43219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcagcgacatgcctgtagggaacgtgcg

SEQ ID NO: 43220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcaggacctagcggacgaggtggcggcg

SEQ ID NO: 43221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcatcgaacgtcctgcgtcttcgttagc

SEQ ID NO: 43222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggccagcaggggtctgttaggttatcgaa

SEQ ID NO: 43223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggccccgcaccggcacatcctcgatgatt

SEQ ID NO: 43224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggccggacaggtgcatggcagcgcgccgg

SEQ ID NO: 43225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcctcgttggatggttcattcaagcgtc

SEQ ID NO: 43226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcctgggcgcgacttccgtgccttttgg

SEQ ID NO: 43227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgaagtgcaatctctgatgctgccgct

SEQ ID NO: 43228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgacccgtcgactctgttggctgtgtt

SEQ ID NO: 43229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgagcatcggtatttgtcctcatgccg

SEQ ID NO: 43230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgataagcaattgttggtacggtcggc

SEQ ID NO: 43231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgataagtcacgttctctaacgcgttg

SEQ ID NO: 43232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgatagagcatcagatgcagtcgcgca

SEQ ID NO: 43233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgatgccgagcagaaatcacgatcttc

SEQ ID NO: 43234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgcaactgtaaagcgcacaaagttcct

SEQ ID NO: 43235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgcggcttataaatagcttctaccgtt

SEQ ID NO: 43236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgctaataccgattatgcaagaatacg

SEQ ID NO: 43237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcggacggcatcaccctctcgcgcgtgg

SEQ ID NO: 43238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcggatcgctggtgaatgatatttctcc

SEQ ID NO: 43239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcggggagtcggtaaatcaatgccgaga

SEQ ID NO: 43240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgggtctgcaagtaacgtcgggaagtg

SEQ ID NO: 43241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcggtcaggaggcagatgggcttagctg

SEQ ID NO: 43242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcggtcgaggatatacctttgcatggcc

SEQ ID NO: 43243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgtaaggcagtacctagtgggcgtccg

SEQ ID NO: 43244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgtgctggaggggattagcgatggaag

SEQ ID NO: 43245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgttagatgggaacgttataacacaga

SEQ ID NO: 43246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcgttcgcaattcgaagtcttggtggca

SEQ ID NO: 43247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctaccgaattatagggtttgcctgtcg

SEQ ID NO: 43248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctacctagtaaggggctctgaagtttt

SEQ ID NO: 43249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctagaattggaatcccggttcctaaag

SEQ ID NO: 43250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctcacacctccccaaggtcagcagatg

SEQ ID NO: 43251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctcgatatacgatctccgggaaaggtt

SEQ ID NO: 43252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctctcggtcgtcccggtacaactttcg

SEQ ID NO: 43253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctgcaaatgtgtgatccctaaggttgt

SEQ ID NO: 43254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctggcaacggtgtccgacttatgcccc

SEQ ID NO: 43255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctggtcctgctcccatttcggcgtgat

SEQ ID NO: 43256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctgtcggaaactgtgcttgaatatgcg

SEQ ID NO: 43257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctgtcgtgttgtccactaactgcagac

SEQ ID NO: 43258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggctgtctgcaaccccggttcggccacgg

SEQ ID NO: 43259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggcttgctctccggatgattttgtcttgc

SEQ ID NO: 43260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggaagcatagatggcggcaagatgcgta

SEQ ID NO: 43261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggacatctaaggcgatcccgttagtcca

SEQ ID NO: 43262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggacattgacgcagcgcgaatctgggat

SEQ ID NO: 43263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggacgaagccactgtccattttgcttgt

SEQ ID NO: 43264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggacgactccaactccgctcgcatagcc

SEQ ID NO: 43265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggaggggcatcgctttaaaaatggcacc

SEQ ID NO: 43266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggaggtgggtgaactacatgcgacgatt

SEQ ID NO: 43267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggatgcaacagtgttggtggaggctgga

SEQ ID NO: 43268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggatggctggaccaacggctgatgcggg

SEQ ID NO: 43269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggatgggatttcccggggcttgcctccc

SEQ ID NO: 43270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggatgggtcaagtagtggttttggatgt

SEQ ID NO: 43271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcacggagtctacagcgatcaacgtcc

SEQ ID NO: 43272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcatatgagcgtaggtccgtaagctct

SEQ ID NO: 43273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcatgacgtaactgaaccgtgtgcttt

SEQ ID NO: 43274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggccacaaaagccgaccgggagactccg

SEQ ID NO: 43275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggccagcgtcatactccatgatcattat

SEQ ID NO: 43276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggccgggtacagcgattgcgttggtgcg

SEQ ID NO: 43277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgatctccttctaaacagcagttgat

SEQ ID NO: 43278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgcctgagtattgctaactaacaacg

SEQ ID NO: 43279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgcgagaggtccattgatcagcgcta

SEQ ID NO: 43280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgggctgaatggagttaactgggatc

SEQ ID NO: 43281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgtcaatcttgaccgtgctgcgtagc

SEQ ID NO: 43282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgtgacgatatccgacggtaatactg

SEQ ID NO: 43283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggcgtgacggttattcggcgtcatcact

SEQ ID NO: 43284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggctcgcaaaaggattggtatattcgtg

SEQ ID NO: 43285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggctgtgctcaggactttcgagcagggt

SEQ ID NO: 43286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggacaatcagagggctactcgtagagt

SEQ ID NO: 43287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggaccagaatggttgcagcgccttggc

SEQ ID NO: 43288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggagcggtgcgtacgagcggtttctct

SEQ ID NO: 43289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggataacattcctcgcgggaacagcga

SEQ ID NO: 43290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggatacactcacacggatgcgtttacg

SEQ ID NO: 43291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggatggttttacgactcatacggtacc

SEQ ID NO: 43292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggcaaaggtacaaatcagagctcgaaa

SEQ ID NO: 43293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggcaactggtcaaacggccagacagtg

SEQ ID NO: 43294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggcgtcggacgtgtctggcttttggga

SEQ ID NO: 43295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggctgcttatctgtgtagcttgctgac

SEQ ID NO: 43296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggggaagttgcgtggctgtcggatgctt

SEQ ID NO: 43297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggggatctgcattaggcgtttaccagct

SEQ ID NO: 43298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggggctaaggtctcgtggctctgttcgg

SEQ ID NO: 43299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggtaaccccgcgatgacgcttagggtc

SEQ ID NO: 43300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggtaagcgactttgggtgttacatatc

SEQ ID NO: 43301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggtacgggggcaaaggttttcactcgg

SEQ ID NO: 43302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggtctggcgatgccgttaagagctacc

SEQ ID NO: 43303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggtctttggacgacatttcttaggctc

SEQ ID NO: 43304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggttatgcatggaagtggacaacattg

SEQ ID NO: 43305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggttcgcgcttcgacataaatcgtgtg

SEQ ID NO: 43306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggggtttgcacgaccgcgggccgttatct

SEQ ID NO: 43307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggtaaggtggaggggatcacttcgctct

SEQ ID NO: 43308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggtagctgtttggtaagtaccgttcggt

SEQ ID NO: 43309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggtaggatgagcatggcgggtacagctt

SEQ ID NO: 43310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggtcattgtcgaatgagttaaatgtctg

SEQ ID NO: 43311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggttgggagccgtttacttgatactatc

SEQ ID NO: 43312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgggtttatgcagtccgccactcacacccg

SEQ ID NO: 43313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtaacatgtattcatgtggaagtggctc

SEQ ID NO: 43314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtaacgcgtataatgcattgcggtcagc

SEQ ID NO: 43315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtaactcaagcagcgtcacgcaggttgc

SEQ ID NO: 43316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtaatagggtatagcagatccggaagac

SEQ ID NO: 43317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtacaggatcgcaggaacggttgcgcgg

SEQ ID NO: 43318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtacgcgacaaaacaccgagtccccgtc

SEQ ID NO: 43319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtactatgtagtttgtgttttagcactc

SEQ ID NO: 43320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtagcgaatcagggggatacgatggcct

SEQ ID NO: 43321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtaggagatgacaacatccgcgtcgaat

SEQ ID NO: 43322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtagtgtcttctcgtatggcactggagt

SEQ ID NO: 43323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtatgggtcgtccgtattctagtcgtcc

SEQ ID NO: 43324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcaagtgccagtctatgcctcctttgt

SEQ ID NO: 43325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcacacggtcttcagcctcatacgtgg

SEQ ID NO: 43326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcaccgaaactagtctcaccgttgcgg

SEQ ID NO: 43327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcaggtgactggatcacactggtatgg

SEQ ID NO: 43328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcatgaggcttagtcgggggctctgtc

SEQ ID NO: 43329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcattgcagtggggttcggctgacgcg

SEQ ID NO: 43330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcatttacgcaatatcagctaggacta

SEQ ID NO: 43331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtccctggaagtaccgcactaatcttgt

SEQ ID NO: 43332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcctgcgcgaactcgtgatcttgaatc

SEQ ID NO: 43333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcggaacgtgtcatggaatgtctatcg

SEQ ID NO: 43334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcgtcgcagagccataggcctcctgtg

SEQ ID NO: 43335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcgttccccttgtggccaggtgccccc

SEQ ID NO: 43336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtctacagtttattccatgtttagattt

SEQ ID NO: 43337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtctactggattcggggattcgttagat

SEQ ID NO: 43338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtctcacacatgggctggcgttggtcgt

SEQ ID NO: 43339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtcttggggtttcagcactggttattgg

SEQ ID NO: 43340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgactgatagtgctcggctcatcactg

SEQ ID NO: 43341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgatacgttttcgtgctatgttgtcgc

SEQ ID NO: 43342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgatcaacggccgtccttttgagcccg

SEQ ID NO: 43343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgatcaggtggcggtaggtatgtgtgg

SEQ ID NO: 43344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgatctgcgacgaatgaggggaactgc

SEQ ID NO: 43345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgcagtccagccatccgctcttttgct

SEQ ID NO: 43346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgcatgacacgctcgctgtttatatga

SEQ ID NO: 43347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgcgaagtaagcctcatgcactgatcg

SEQ ID NO: 43348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgcgttgactagtgccacatgtctgtc

SEQ ID NO: 43349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtggagggatcatcttcctaggttttcg

SEQ ID NO: 43350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgggctgcagccatgggaggcatttca

SEQ ID NO: 43351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgtatggctgcgcacgtgtttgagcgt

SEQ ID NO: 43352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgtgaccaatttactataccgaatgcc

SEQ ID NO: 43353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtgtgcctccgagctcatgtattctccg

SEQ ID NO: 43354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttaagacgtgttcggactgtggtgggg

SEQ ID NO: 43355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttaattgtgtgaccacgtagagatcgc

SEQ ID NO: 43356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttcacgcatattccgccgtctggggca

SEQ ID NO: 43357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttcatgtctgcagtgcttggaaacttt

SEQ ID NO: 43358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttctcacactttgggctcagatgtcgg

SEQ ID NO: 43359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttgaatggggcacgacgtgtatcgctg

SEQ ID NO: 43360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttgtccatcagatgacatgctgagcgg

SEQ ID NO: 43361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggttgttgcacgtaaggccagaagagaaa

SEQ ID NO: 43362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtttacggggactcaagagcgctgggaa

SEQ ID NO: 43363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtttctactagtttcccgctaacgacgg

SEQ ID NO: 43364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccggtttgcattcgatgcgacactcttctga

SEQ ID NO: 43365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaacatcatatcttgtcggctggcacaa

SEQ ID NO: 43366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaacgccaagagtctttggggggttagc

SEQ ID NO: 43367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaactagccaacaaagtgcccggggttg

SEQ ID NO: 43368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaagcaccggtaagctaggtaacgtggt

SEQ ID NO: 43369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaaggggcatggcgtttttgtatccgtc

SEQ ID NO: 43370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaaggtggtcggtcagtagcgagaggta

SEQ ID NO: 43371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaaggtggtttaggccgaccttaatctc

SEQ ID NO: 43372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaatgagcggtacagtggagttggcggt

SEQ ID NO: 43373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaatttgccagccaagttttggttcagg

SEQ ID NO: 43374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtacaaaacggaactctaattgttgggta

SEQ ID NO: 43375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtacagttgagctggataagtttgtgtgc

SEQ ID NO: 43376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtacccctccccggatctgatttttacac

SEQ ID NO: 43377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtactcctgcaaacaagaacacttcgcgc

SEQ ID NO: 43378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtagaacattcacaattgcacgcccatac

SEQ ID NO: 43379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtagatgcatgacgatgtatcgatttggg

SEQ ID NO: 43380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtagcgtatcacgggtaatggcctcgctc

SEQ ID NO: 43381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtaggctgcctcaacgactcgtcggtcac

SEQ ID NO: 43382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtagttattcctacgtcgttcttgtacct

SEQ ID NO: 43383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtagttcacgtgatcccccggctctgcta

SEQ ID NO: 43384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtatacagagcacgaactcgaaacgtcat

SEQ ID NO: 43385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtatcgcagcgcagcggacgtttagatgc

SEQ ID NO: 43386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtatgcaagcccaaacactcacggcgcct

SEQ ID NO: 43387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtatgcgcatgttaaaagcgtacatcggg

SEQ ID NO: 43388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcaaacggggttgggctcgccttccttg

SEQ ID NO: 43389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcacggtcgcctatcggtcactcctttc

SEQ ID NO: 43390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcactacggtcatgtcctggacctgacg

SEQ ID NO: 43391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcagataacatgaggacataagattttg

SEQ ID NO: 43392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcagatttaaatgccgaggcggctttcg

SEQ ID NO: 43393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcatagtgtctggtacgtacattggccg

SEQ ID NO: 43394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcatattccgtcttaggacgcggcgata

SEQ ID NO: 43395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcatcgctcagctggattgaacccgttt

SEQ ID NO: 43396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccaaacacttcgggtttgcgctgatcg

SEQ ID NO: 43397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccaatcttagatcttgcgttcttcaag

SEQ ID NO: 43398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccaattgattcatgagtctcgacatac

SEQ ID NO: 43399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccaggctgatttcggcacatggcgttg

SEQ ID NO: 43400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccagtaattctcttgcgcgtcttcggt

SEQ ID NO: 43401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccatgcctgtttcgcgtttatgagagt

SEQ ID NO: 43402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcccgccaggtagtcaataggcaaggcc

SEQ ID NO: 43403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccctccataagttgttcacgcatcgga

SEQ ID NO: 43404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccgaaaccaaggggcagcgccggcgtg

SEQ ID NO: 43405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccgaaatgtatttggttcactttatgg

SEQ ID NO: 43406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccgacgtagctgacaaaccccttgcca

SEQ ID NO: 43407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtccgaggcaccgtctattcctgcgtctc

SEQ ID NO: 43408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcctcaatcctttctatcggccaacgtg

SEQ ID NO: 43409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcctgttaacgaatctggggtgcgcggg

SEQ ID NO: 43410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcctttgcctctctggtggctttctggt

SEQ ID NO: 43411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgataacgtggctgccagttaagtcgc

SEQ ID NO: 43412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgccgtcggtcattttacccgatttgg

SEQ ID NO: 43413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcggcaatacaacgtcgttactggaccg

SEQ ID NO: 43414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgtaatcgggtactgggattaaacgga

SEQ ID NO: 43415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgtacccgctttcgttttagacgcaca

SEQ ID NO: 43416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgtagttccgccccggtgtcgtatgta

SEQ ID NO: 43417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgtcaattccctagatcatgcctggaa

SEQ ID NO: 43418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcgtttagttcggtttttcgttagcttt

SEQ ID NO: 43419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtctacacgaccagtgcccccgatccctt

SEQ ID NO: 43420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtctactcagtcagcgattcacgactcat

SEQ ID NO: 43421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtctactcgtaccttctaactggatctag

SEQ ID NO: 43422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtctcgctctgatccattccacgtctagg

SEQ ID NO: 43423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtctcgttttattaactaatcatgcaagg

SEQ ID NO: 43424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtctgatagtgtctgcggtggaggtcagc

SEQ ID NO: 43425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtcttgattgggagtaggtttttcttctt

SEQ ID NO: 43426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgaagtgctcgcccggcatactttatga

SEQ ID NO: 43427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgacgcggtcagtcatttatacatacct

SEQ ID NO: 43428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgacggtcggttagtattaaagcctctt

SEQ ID NO: 43429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgagatcgaggtaactaagagtgattcg

SEQ ID NO: 43430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgagtaggcttggatatagacgtactat

SEQ ID NO: 43431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgatatcttagaggctacttttggtcac

SEQ ID NO: 43432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgatgaatcttccctccagcggttccgt

SEQ ID NO: 43433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgatgctgcgcgcaatccttggtggata

SEQ ID NO: 43434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgcaagctaggtacctctcacctggcgc

SEQ ID NO: 43435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgcacagggacttgttttcttgtctgtg

SEQ ID NO: 43436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgcatactgattattggtggacgtacaa

SEQ ID NO: 43437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgcggacttggagccctgtcgcgtgacg

SEQ ID NO: 43438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgctgggggtcacttgcttctgcacgat

SEQ ID NO: 43439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggaaatcggagcggtcggatgcccgag

SEQ ID NO: 43440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggcagatcgcgcgaattcttaatccga

SEQ ID NO: 43441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggcgcgcgtaggatcattgcggtctct

SEQ ID NO: 43442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggcggttgacacctctagctggttccc

SEQ ID NO: 43443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggcgtagctcccgcaccgtggagtggg

SEQ ID NO: 43444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggctgtcgtattataggcatggtcaac

SEQ ID NO: 43445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgggaagctatgaagttcgaaccagttg

SEQ ID NO: 43446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggggagtcttcaacttcggacgctacg

SEQ ID NO: 43447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgggggcctcaatccagatagccgtacg

SEQ ID NO: 43448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggggtgggcacgataccgaggaacatc

SEQ ID NO: 43449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgggttcgctgactgacctctttcatca

SEQ ID NO: 43450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggtaacagaagagtgtaattaatgttc

SEQ ID NO: 43451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggtatccgacaagaccgggcaacaccg

SEQ ID NO: 43452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggtcttgtttggcaagcatcgactgtg

SEQ ID NO: 43453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtggtgtgcgccaagggaggcaaagggac

SEQ ID NO: 43454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtactgtttagtctacagactggtatt

SEQ ID NO: 43455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtaggactcgccgggttccatatgggt

SEQ ID NO: 43456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtatggatagggtacatagcgcgcgtt

SEQ ID NO: 43457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtctgggacgtatcccctagcttcgac

SEQ ID NO: 43458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtgccacctcgatttggccatcctcgt

SEQ ID NO: 43459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtgcggaacagtaacctcggcctagtc

SEQ ID NO: 43460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtggactgcgcgggatcgttgctcttt

SEQ ID NO: 43461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgtgttcagacaggattcgggatcattc

SEQ ID NO: 43462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtgttctgcagagtcagcgaccgtcccgg

SEQ ID NO: 43463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttaacgaagtaatctcctgactttgatg

SEQ ID NO: 43464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttaactgtgtatgtaggacatcgaccga

SEQ ID NO: 43465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttaatgccaaatcgatgcaggctcgtcg

SEQ ID NO: 43466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttaccgctagtagtattgtcttcacgtt

SEQ ID NO: 43467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttagctctcgtgttttaccgcggtgatc

SEQ ID NO: 43468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttaggctacaccaggattgtgctaggtt

SEQ ID NO: 43469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttcatgcggtggctatcttggcgcgcta

SEQ ID NO: 43470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttcggtctttctgatcggctattcggcc

SEQ ID NO: 43471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttctctacgatacagctgttactggaag

SEQ ID NO: 43472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgaaaacactaatagtccgctcgtgcc

SEQ ID NO: 43473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgcaagactcgtccaaccactgttgtt

SEQ ID NO: 43474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgcaaggattgaactaggctttgatga

SEQ ID NO: 43475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgcaggggtattagatgccaaacgctt

SEQ ID NO: 43476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgctttagcgcactagcacattacacg

SEQ ID NO: 43477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttggaaggtggcggcggggcatgttccg

SEQ ID NO: 43478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgtatacgtgggaccggcttcaatgtt

SEQ ID NO: 43479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgttgttttccactctaaaggtgtataggc

SEQ ID NO: 43480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtttacgtcgtggcggcatagtagcggat

SEQ ID NO: 43481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtttcccttttctcgcatcttcacagccg

SEQ ID NO: 43482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccgtttctggatatccgttttccatccctgg

SEQ ID NO: 43483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaaatgaactccaaaccgaaatgttgaca

SEQ ID NO: 43484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaacagtaagcggaacgtacagagcataa

SEQ ID NO: 43485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaacattatttatgacattgctgtaacgc

SEQ ID NO: 43486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaacccgttctggtcgtcaaaatgactca

SEQ ID NO: 43487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaacgcttgagttgttcagttgcccacac

SEQ ID NO: 43488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaagttagatcggtacgccgcggttacgg

SEQ ID NO: 43489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaattggtggggctggaatcatgcttctc

SEQ ID NO: 43490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacacagcgtgcgctaacgatcacagctc

SEQ ID NO: 43491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacactcctttacaaataatgtgcacaca

SEQ ID NO: 43492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacagcagcgtccaggcgatgaggtggcg

SEQ ID NO: 43493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacaggacggccctatcaatggcttaggt

SEQ ID NO: 43494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacattaacccggtacggagcaatgacgc

SEQ ID NO: 43495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaccaaaacgcggcgcttttttctggtgg

SEQ ID NO: 43496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaccacgacgggcgatacaaggcgcttgg

SEQ ID NO: 43497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacccaagcggttggctgcgttcgcacgg

SEQ ID NO: 43498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaccgagccttaaccacctctccctcatc

SEQ ID NO: 43499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacctagaagccccgtgcatccaccgctg

SEQ ID NO: 43500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacctcaaacctggacattggggaacagt

SEQ ID NO: 43501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgaacggtgattcttgatctggctctc

SEQ ID NO: 43502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgaagccctcgaggtactcattattcc

SEQ ID NO: 43503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgacagtgctaggccaccttgtcctcg

SEQ ID NO: 43504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgagaaagactccatgttatcgggggg

SEQ ID NO: 43505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgcagagcctagcctcgcgaccctggg

SEQ ID NO: 43506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacggtaaggtccggtgctcatcgttggc

SEQ ID NO: 43507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgtcacgacgcgattcgctctctacca

SEQ ID NO: 43508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacgtgggatgttacccgcccataggcgc

SEQ ID NO: 43509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactagacaacgatacagccaacccggtt

SEQ ID NO: 43510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactaggggggaacaaaggcggacagaaa

SEQ ID NO: 43511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactcccggatcagctgtactcgccccgc

SEQ ID NO: 43512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactccttggtcagactgtttagctgagc

SEQ ID NO: 43513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactcttatgcagggacagggggcggagg

SEQ ID NO: 43514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactgcgatttcgacgcacagcttgggtc

SEQ ID NO: 43515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactgtaacgggagctacgtcaccttgca

SEQ ID NO: 43516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactgtacttgcggggtcattgatcaatc

SEQ ID NO: 43517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactgtgcctcgagggccatgctcttcgg

SEQ ID NO: 43518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctactgttggctttggacggtgcataatcg

SEQ ID NO: 43519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctacttaatgaattagatggatttcacagg

SEQ ID NO: 43520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagaccttccctggtacggctgaatgtat

SEQ ID NO: 43521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagagaaccggtttctaagacctctgatc

SEQ ID NO: 43522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagagacaagtacggtcataacgacaatt

SEQ ID NO: 43523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagagattaagcatcgtggcataacacac

SEQ ID NO: 43524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagagcacacattggagcgtattatcgcc

SEQ ID NO: 43525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagataatgctaacaggtagtgtgatggt

SEQ ID NO: 43526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagatgatgatggtgccggaccgattgta

SEQ ID NO: 43527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagcagatgcaggatttaagggcacggtc

SEQ ID NO: 43528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagccgcatagcccggttggacccttggg

SEQ ID NO: 43529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagcgaacgtgcactgaggtccctggctc

SEQ ID NO: 43530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagctctcactatctgttaaatggatgcg

SEQ ID NO: 43531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagctctttcgaattttggcagggagttc

SEQ ID NO: 43532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaggactgatgtgcgagccagtttaggtg

SEQ ID NO: 43533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaggcacttttagctctttacgccggagt

SEQ ID NO: 43534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctaggctcgcaccactactgtcgtaaatgg

SEQ ID NO: 43535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagtaaggagttaatgggtgcgcaaactt

SEQ ID NO: 43536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagtactgcctttgtcagagaggcacgct

SEQ ID NO: 43537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagtagtgcaccgccccgggttctgacac

SEQ ID NO: 43538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagtatcttcgtcacggggagtatcgctg

SEQ ID NO: 43539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagtcattgctcatttgactgccgagggt

SEQ ID NO: 43540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctagtgtgggatggttggggaattggtcgc

SEQ ID NO: 43541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctataaacgccaaggcacacggcgttatta

SEQ ID NO: 43542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctataagggcaaggtgtggtcccaggacga

SEQ ID NO: 43543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatccctttcgtagagccagcgcaccggg

SEQ ID NO: 43544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatcgatgcagtaggccgtacagaacccg

SEQ ID NO: 43545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatctcaaaggcacgctccttatcatcgg

SEQ ID NO: 43546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatctgcatcgttgtttctccgggtaggg

SEQ ID NO: 43547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatgatgacttgggtagcacgaccctgtc

SEQ ID NO: 43548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatgcgggatcattcaacacgactcgaca

SEQ ID NO: 43549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatggacaattggagcatgagtcgccccc

SEQ ID NO: 43550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatggacgacaaaagtcagatggttttga

SEQ ID NO: 43551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatggctggcggcactgggacacgccggg

SEQ ID NO: 43552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatggtaacgactattgttcataagggca

SEQ ID NO: 43553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatgtgtgcacaacaactcggtcgacgtt

SEQ ID NO: 43554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatgttattataataggtatcgagcgtgt

SEQ ID NO: 43555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctatgttcaggcaaaaatggggtcacgatt

SEQ ID NO: 43556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctattacaattttacgcaacactctttgca

SEQ ID NO: 43557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctattgagcctcctttccgtcgtaatctga

SEQ ID NO: 43558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctattgggtcactgtttgtacttgcgatgc

SEQ ID NO: 43559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaaatgccacgctcactcacgcactcta

SEQ ID NO: 43560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaacgacttccgtatgcttggccggcaa

SEQ ID NO: 43561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaagaaactggatatttatcgccgttca

SEQ ID NO: 43562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaataggggagaagtaagggggtccggg

SEQ ID NO: 43563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaatttgctatcttactttttagcgatt

SEQ ID NO: 43564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcacatgccggctttccagactgactggg

SEQ ID NO: 43565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcacccatacattcttgttgttgctgatt

SEQ ID NO: 43566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaccccactaacgcgcgcaacggttagt

SEQ ID NO: 43567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcacccctatccccacctactgcgaacac

SEQ ID NO: 43568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaccgccttgggaagaatttcgagagcc

SEQ ID NO: 43569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcacggatgacgacgcagtagttcaagtc

SEQ ID NO: 43570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcacgtttaccgaccggattctgccacgg

SEQ ID NO: 43571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcagagggaatgttattaccgattcgatc

SEQ ID NO: 43572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcagcgcatgggtacgctacgagaccgcg

SEQ ID NO: 43573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcaggcgatccatgcggcttggcgagtgc

SEQ ID NO: 43574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcagggtctacatcgtcccgctgtttggg

SEQ ID NO: 43575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcagtacacctttcttttaggagagcaat

SEQ ID NO: 43576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatactccagaagtgatgtattttaata

SEQ ID NO: 43577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatctgtccgaacgccggacgtcgcttg

SEQ ID NO: 43578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatgaagacgcactacgtccggactcgg

SEQ ID NO: 43579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatgtctagtctccacacttagatgtct

SEQ ID NO: 43580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcattcctttggttaatcttggaggcgat

SEQ ID NO: 43581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcattctggttgcctatcgtgctgcgctg

SEQ ID NO: 43582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcattgcccggtaggcccttagcggtgcc

SEQ ID NO: 43583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatttaaaccacgcgacttagtgttggt

SEQ ID NO: 43584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatttacattccatttgcgcgagcggta

SEQ ID NO: 43585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcatttatgggacgttctctcagtcatgt

SEQ ID NO: 43586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccacgtgagactactgttgcaacgtcga

SEQ ID NO: 43587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccaggcggttggttgctccgctatcggc

SEQ ID NO: 43588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccatagagctgttacgttaagttcggtc

SEQ ID NO: 43589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccccagcggcaaactggtgtaggtgtat

SEQ ID NO: 43590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcccgataccgcctcctctcgcttctaat

SEQ ID NO: 43591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccgaacctggttggcgtacttgggtgac

SEQ ID NO: 43592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccgcggaacgtggctgtcgcctagaacg

SEQ ID NO: 43593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccgggcttacaccagatccacgtctaag

SEQ ID NO: 43594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccgtagacaccttgtaatagagagccac

SEQ ID NO: 43595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccgtcggcttgttttgtggcaatctctc

SEQ ID NO: 43596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccgtgtatgcctaactggtagcgctctt

SEQ ID NO: 43597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcctgggagtctgacgatattccgcggct

SEQ ID NO: 43598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcctgtggtagtatggaggcactgactcc

SEQ ID NO: 43599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccttgggcataggtgttggacgccattg

SEQ ID NO: 43600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctccttgggtcagccctcgactcgtacgta

SEQ ID NO: 43601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgaacgatgacgtcaacccagagactcg

SEQ ID NO: 43602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgaagcacgcataatttgctccctctcc

SEQ ID NO: 43603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgacgcgttttattatttgtccgctgcc

SEQ ID NO: 43604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgagactcacacaatttctccgttcgtg

SEQ ID NO: 43605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgagcagctcaatcgaaccccactatcg

SEQ ID NO: 43606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgaggtgggcttctgggggcgggctacg

SEQ ID NO: 43607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgatgacgggcgtcacgggtcttgtcgc

SEQ ID NO: 43608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgattacttttttatgcgcgtggtctag

SEQ ID NO: 43609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgcactcgttaaaactggttcgatagag

SEQ ID NO: 43610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgcactgttttcacttgggtttccctta

SEQ ID NO: 43611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgcgcacggggatgggcaatgcatgagt

SEQ ID NO: 43612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgcggaatcgttaaacttacacctgttg

SEQ ID NO: 43613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgctagattacagttgttgcccggccac

SEQ ID NO: 43614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgctggtcggattctgtataacccactt

SEQ ID NO: 43615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggaccggtggcacgggggtcttacgca

SEQ ID NO: 43616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggactaattccatggatagcctgagcc

SEQ ID NO: 43617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggagcgcgcttttctgtttggttcgac

SEQ ID NO: 43618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggagtatttccgcgacttgaatttgac

SEQ ID NO: 43619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggccctcgcatcgtggaagatctcgat

SEQ ID NO: 43620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggccgtcccaagcatttttgcggtacg

SEQ ID NO: 43621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggctacggttctccctcgtacaggcgt

SEQ ID NO: 43622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgggagctcaatcagatccgtttggtgt

SEQ ID NO: 43623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggtctgttacctggtgggtgaaaggcg

SEQ ID NO: 43624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcggtgttcccatcttctcgccgtttccg

SEQ ID NO: 43625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgtacgagtccactgggcctttgtgtga

SEQ ID NO: 43626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgtcaatgtcgatagctagtacttctcg

SEQ ID NO: 43627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgtcgtcaggttgagaccacatgcttga

SEQ ID NO: 43628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgtgctccgccaacgcgcgtaatacgct

SEQ ID NO: 43629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgttatctaagggacgcaccgatcgatc

SEQ ID NO: 43630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcgtttggtgattccttttggcaggtgtt

SEQ ID NO: 43631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctaaccgtgttacgcgtagcctccactg

SEQ ID NO: 43632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctatcagtagggtaattttatgttgcct

SEQ ID NO: 43633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctatcgattcgtgcatcccgcgatcgcc

SEQ ID NO: 43634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcagtagcttgtcccgcactcgagtcg

SEQ ID NO: 43635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcccgcgtgtgttattcgacgccccgc

SEQ ID NO: 43636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcgacaagtaaacaccgcccccagccg

SEQ ID NO: 43637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcgctaccacgttctccctctgaagtc

SEQ ID NO: 43638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcgtcagattttctggcgggacctgcc

SEQ ID NO: 43639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcgtctattagtagccttagtcgaacc

SEQ ID NO: 43640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcttggtctaatcgactacgttcatcg

SEQ ID NO: 43641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctcttgtgaatcgtcatagtgagggacg

SEQ ID NO: 43642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgatgtcttaaggggggtttgaagggc

SEQ ID NO: 43643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgccataagaatgatgggacaaaccgg

SEQ ID NO: 43644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgcgcagtccgagtaattgatgtcggg

SEQ ID NO: 43645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgcggggatgtaggtcctggaagcgaa

SEQ ID NO: 43646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgcgttatttcagctagataacggaat

SEQ ID NO: 43647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgggagtggagtacatctaatagtgta

SEQ ID NO: 43648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgggtcgcgtatgttgctgcagtggcg

SEQ ID NO: 43649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgtcgtcatgacacaagtcggctgtcc

SEQ ID NO: 43650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgtgcagtaactaatgcgtcttttcta

SEQ ID NO: 43651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgtgtgtgccacgttctggaaatgtcg

SEQ ID NO: 43652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctctgttcctttagctacaggagtcgattt

SEQ ID NO: 43653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcttagagttgtctggcttgggatcacgt

SEQ ID NO: 43654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcttcatgtgtgggttattgtggagcgcg

SEQ ID NO: 43655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcttcgagttagatgctggcacgcgtcac

SEQ ID NO: 43656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcttgcctttgttggggtatgggcggccg

SEQ ID NO: 43657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcttgggttcttcagtgttatggtgagaa

SEQ ID NO: 43658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctcttttcggtcggaagcagcattgggaag

SEQ ID NO: 43659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaaaaaccctatatccagtctggcagaa

SEQ ID NO: 43660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaacgtcacagcacatatgcacccgaca

SEQ ID NO: 43661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaagaggccgcgcgtcgactgcacagtg

SEQ ID NO: 43662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaagtaatcgatcagcaatgcaagtgtg

SEQ ID NO: 43663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaagtgggcgcttaacaggatcacaccc

SEQ ID NO: 43664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaagtgtgactgtcctcgggaaaggcgg

SEQ ID NO: 43665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaatcggagggtttacattgctttcgat

SEQ ID NO: 43666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgacagaggggcgttcactctaccggata

SEQ ID NO: 43667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgacaggaaccctgcgctacgttgaacca

SEQ ID NO: 43668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgacccaaattctggtgttcactttgcaa

SEQ ID NO: 43669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgacgctcagttcgtgccactcgttccgc

SEQ ID NO: 43670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgacgggtgtaggatgttcagctggtgtt

SEQ ID NO: 43671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgactccggtcaccaggatgctcttcgta

SEQ ID NO: 43672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgagaacaggggggaaggagtatgcgtag

SEQ ID NO: 43673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgagagtggtggtgtcgtgacctaattgt

SEQ ID NO: 43674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgagcgtaggtcttgtcctgttacaggat

SEQ ID NO: 43675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgaggatgtcttgtttattcggctttccg

SEQ ID NO: 43676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgagggcgcgttcaacaccatctccgctc

SEQ ID NO: 43677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatcagtggcgttactcaccaaggagtt

SEQ ID NO: 43678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatcggacattcaccttatcgcacgccg

SEQ ID NO: 43679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatcgttcgaacagaggagccagaagta

SEQ ID NO: 43680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatgactgtctcgcgctgggttttaggc

SEQ ID NO: 43681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatgatgtagcacgtgtaattcattctg

SEQ ID NO: 43682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatggcgtaggttcagacccccttctcg

SEQ ID NO: 43683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatggtatgaatatctgggtccagcacg

SEQ ID NO: 43684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgattgtgttatcggaggaatggtgcact

SEQ ID NO: 43685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgatttgcgcggatgtcggatgagatgaa

SEQ ID NO: 43686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcaagagcgttagggcggacttcaggtg

SEQ ID NO: 43687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcaaggttgctcggttggtaggcatttc

SEQ ID NO: 43688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcaagtttacgtgtgggtctatctgtag

SEQ ID NO: 43689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcaatccagcgtcaaccccgttagcact

SEQ ID NO: 43690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcacccaaacgaattggccccaacttag

SEQ ID NO: 43691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcaccgcgagagaatgtggacctcggct

SEQ ID NO: 43692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcacgtctgttatcccgcattgagcttg

SEQ ID NO: 43693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcactgaccatttccgagctgagagata

SEQ ID NO: 43694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgccgcttggtcagtcaatgacaattgac

SEQ ID NO: 43695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgccggattagcgttttatggtcgtcact

SEQ ID NO: 43696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgaacgcttctatgatgtgtcaggcta

SEQ ID NO: 43697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgacgatgactgtgcccggtcgtatgt

SEQ ID NO: 43698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgcgcggaacccgggtctggaaagcgt

SEQ ID NO: 43699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgcttcactcgtaactcccgggtggat

SEQ ID NO: 43700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcggcatacaccctctattaacccctca

SEQ ID NO: 43701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcggttagagcggctgaagctaagtggg

SEQ ID NO: 43702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcggttttgctatcctcgccggtgccgc

SEQ ID NO: 43703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgtagtcttgggtggaagcccgtgcct

SEQ ID NO: 43704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgtcgactactccggttgacaagggat

SEQ ID NO: 43705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgcgtggattatctgctgtaattgtgcat

SEQ ID NO: 43706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgctagcgattagccgtcgtgatgttcgg

SEQ ID NO: 43707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgctgaggtggcgcgtagcgggatgtcga

SEQ ID NO: 43708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgctgctggagttcccgggttctgctttg

SEQ ID NO: 43709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggaatactggactcagcgtacccgggct

SEQ ID NO: 43710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggacaacacggcgggccgagaggcatta

SEQ ID NO: 43711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggacatatcatcacatgagtgctcagga

SEQ ID NO: 43712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggaggtgtcgtcagacgcagttttaggc

SEQ ID NO: 43713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggaggtttggtgaagtctcggctttctc

SEQ ID NO: 43714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggagtccgttttcggctcacccctgagg

SEQ ID NO: 43715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggatcataatgcgggaattttgacgggc

SEQ ID NO: 43716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggatcgtatgaccccgcacttattctgc

SEQ ID NO: 43717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggatgtacaaatttatataggtcggcac

SEQ ID NO: 43718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggcaagagagctttcaatgctgagagga

SEQ ID NO: 43719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggcattgctcgaatatctccatcaccgt

SEQ ID NO: 43720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggccgtgaggaatcttgggttgcatata

SEQ ID NO: 43721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggcgtcaacagaggggatcccggctggt

SEQ ID NO: 43722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggctgtgggatctgaacctaccgtcccg

SEQ ID NO: 43723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgggagttatccacgtcctggctcctcgg

SEQ ID NO: 43724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgggatatgaggtaaacagcttgttagta

SEQ ID NO: 43725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgggcgcaaacacctagtgccggatccca

SEQ ID NO: 43726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgggcggacgcctaaacaatattgcgcat

SEQ ID NO: 43727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggggagatacatgcgcgcactctccgct

SEQ ID NO: 43728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgggggaagctcacgattactgtgggtcg

SEQ ID NO: 43729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggggttccgcgcaaggtctgatcaactg

SEQ ID NO: 43730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggtaggagggagggaaggggcagccata

SEQ ID NO: 43731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggtcatactacgttgttttactagtgtc

SEQ ID NO: 43732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggtccgattgtctgctggatacccgatc

SEQ ID NO: 43733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggtcggaatcatgggttagcgggtctac

SEQ ID NO: 43734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggtggagacgcttcggtgctcttggcgg

SEQ ID NO: 43735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctggttgaatattgacgttactggacgcgt

SEQ ID NO: 43736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtaccacggatcggtattcgctatgagg

SEQ ID NO: 43737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtaccccctgagcccgttggcaaccatc

SEQ ID NO: 43738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtactggaccgtatggtggaagttgcta

SEQ ID NO: 43739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtagacagctccttctttttacccactc

SEQ ID NO: 43740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtatatgagatagggttgcgccgaacga

SEQ ID NO: 43741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtcaatcatcacgacagccgtctcactg

SEQ ID NO: 43742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtcatgaataatgataggaagctcagta

SEQ ID NO: 43743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtccaggggcttgagataatccggtaac

SEQ ID NO: 43744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtccggcttgcctttcgagcgggtgaca

SEQ ID NO: 43745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtccttacgatttggttattacgctttc

SEQ ID NO: 43746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtcgcacttggagaacacccttgcccgg

SEQ ID NO: 43747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtcgccgtcggagggtgtagcatggttc

SEQ ID NO: 43748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtcgggctgcggcgctgggtaggggctg

SEQ ID NO: 43749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgaccgtgcaatgggagaatggggtcg

SEQ ID NO: 43750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgataaacgatcatacgtgacggcatc

SEQ ID NO: 43751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgcacaatcgggtcgttgtgtctgtat

SEQ ID NO: 43752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgccgttctcattttctgttgtaattc

SEQ ID NO: 43753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgcgtgaattcgcaagtgaatgaggta

SEQ ID NO: 43754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgctcaggtagcggagatgggcataaa

SEQ ID NO: 43755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgcttgggacgctcccgatcgccatct

SEQ ID NO: 43756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgggcaaagctttagggcggttttttt

SEQ ID NO: 43757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtggtaactgaggtaggcaatcgacatg

SEQ ID NO: 43758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtggtcgagcattgaggtatcttgagga

SEQ ID NO: 43759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgtaccacggtataaggtccgcccgtg

SEQ ID NO: 43760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgtgaaagccggacattgtgcctcgcc

SEQ ID NO: 43761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgttccgtctacccgggctctatatag

SEQ ID NO: 43762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgttgcccagtcattactcccttgtgc

SEQ ID NO: 43763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgtgtttaaccatgcgtgccgttgtatca

SEQ ID NO: 43764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgttactactcactaggccacgtccctgc

SEQ ID NO: 43765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctgttgatcatatctcggcatgctacgggg

SEQ ID NO: 43766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaaaaacacaccctatcgacgaggaatc

SEQ ID NO: 43767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaagcatatgctggaggagttaaatgct

SEQ ID NO: 43768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaagttagaactaacacggctcctgtat

SEQ ID NO: 43769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttacaaaacctctttcttcaacaattgtc

SEQ ID NO: 43770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaccatcagcgatctattggatcctgta

SEQ ID NO: 43771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttacgcggggtcactccattggtcgatgc

SEQ ID NO: 43772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttacgcttgtgtggttatggaacctcggg

SEQ ID NO: 43773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttactaccgggacttcgggcgggggcggc

SEQ ID NO: 43774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttactgatgtcgtctgttcggctgtgtgt

SEQ ID NO: 43775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttagagggatgacctgcgtgacggggtcg

SEQ ID NO: 43776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttagatagggaaccggcgataaatggcaa

SEQ ID NO: 43777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaggattctctctcaactacaggcggac

SEQ ID NO: 43778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaggcgccttacctcgaatcgctgcgtg

SEQ ID NO: 43779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttaggtcagagctcaactacaaagtgtcg

SEQ ID NO: 43780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttagtggcgttgatatctgttacttgccg

SEQ ID NO: 43781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttagttgtaacttgaatcgttctcatgac

SEQ ID NO: 43782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttataaagccaaattgtaggaggcgcagt

SEQ ID NO: 43783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttataacgcgctaagtcactgttttaccg

SEQ ID NO: 43784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttatgactatcctgcagttcacgcgggcg

SEQ ID NO: 43785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttatggtcgtcgtacaggggggcggtccc

SEQ ID NO: 43786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttatgtcgtctttgtgagtgctcggtctg

SEQ ID NO: 43787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttatgttactcctttctgccatgatttcg

SEQ ID NO: 43788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcaactaccaggtggcggttacttcggg

SEQ ID NO: 43789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcaagctctactactcacatttgaccat

SEQ ID NO: 43790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcaagtgcaccgaagtgcgtacacaccc

SEQ ID NO: 43791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcatcctgttgtttgtgcacggccggtt

SEQ ID NO: 43792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttccacggtagcgcaggcagtttctgagt

SEQ ID NO: 43793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttccagtcaataatcgcacgtcaagacac

SEQ ID NO: 43794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttccccatagaggatggaggtgtgtgaac

SEQ ID NO: 43795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcccgcgagccgagctgaaataacttgt

SEQ ID NO: 43796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttccgatatgacctaggaaagtgatgggc

SEQ ID NO: 43797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttccgggtacaaaaacgtgttgaggcgcc

SEQ ID NO: 43798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcgatgctcattcagatctgacttaccg

SEQ ID NO: 43799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcggggaccgcggcgtacatgtgttaac

SEQ ID NO: 43800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcgtcatccctatgaacgttagttagcc

SEQ ID NO: 43801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttctcgcaggctcacccgaatcaacgccg

SEQ ID NO: 43802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttctgatgaatggacgtggcttaacgttg

SEQ ID NO: 43803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttctgcgggaattagcggggagagtgtct

SEQ ID NO: 43804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttcttgcgtgtattggcagcgtcctcatg

SEQ ID NO: 43805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgaaagtcttagggctgcttatatggga

SEQ ID NO: 43806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgaacctcacccgacagccttgtttgga

SEQ ID NO: 43807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgacacgacttatctcggagacgagccg

SEQ ID NO: 43808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgacaggaccgcactagatccttgctaa

SEQ ID NO: 43809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgacgaaacgggaaggcaccattattat

SEQ ID NO: 43810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgacgggtgcggttggagatatggctgc

SEQ ID NO: 43811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgaggggggatgtaggatttcccgggcg

SEQ ID NO: 43812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgagtggtcggggctctgggtatagtgc

SEQ ID NO: 43813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgatggccgatcacaggctctttaagtg

SEQ ID NO: 43814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgatgttcgttatactgggggaacgctt

SEQ ID NO: 43815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgcccgcttcctccctgggttactctta

SEQ ID NO: 43816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgcgcgattgacacgggcttgttatgcg

SEQ ID NO: 43817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgcgtcgatttgttcccccgaccatgga

SEQ ID NO: 43818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgctccagcgccggtgttagggtcggcg

SEQ ID NO: 43819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgctgggagtaattttctccgcaggaac

SEQ ID NO: 43820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgcttcctgggacgactctctttccctt

SEQ ID NO: 43821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttggaacatagacaccggttggctgcggg

SEQ ID NO: 43822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttggacccatgaaatcgacgagtgccgca

SEQ ID NO: 43823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttggacccgacacccttctaccgctggtc

SEQ ID NO: 43824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttggctacccaatcgatcgctcacgtgac

SEQ ID NO: 43825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttggctgacgatttgcgtgtgtatcgctt

SEQ ID NO: 43826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgggatgtgggcttgatgagcaacggtc

SEQ ID NO: 43827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgggctcgtttatgctgcgcaatgtagc

SEQ ID NO: 43828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgggggataagtgctgagagcatcggcc

SEQ ID NO: 43829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgggtgctcaggagacttgtgtactagc

SEQ ID NO: 43830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttggtacgcgcgcatgaattatccacttc

SEQ ID NO: 43831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgtctcagtaggatcgcggctggtgcgg

SEQ ID NO: 43832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgtctttcttcgagattagcgcgcgcac

SEQ ID NO: 43833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgtgagccgtcgccgtgcgtacctaacg

SEQ ID NO: 43834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgtgatgcttgccataagatggtgtcgg

SEQ ID NO: 43835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgttactactctgggttgcctctacgct

SEQ ID NO: 43836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgttacttcgctaagcggtggctcgcga

SEQ ID NO: 43837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgttgtgcttttcttccctagcgaaacg

SEQ ID NO: 43838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttgtttctccggacggtggtgtcctgctc

SEQ ID NO: 43839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttacacggtggcgtgcggtgtcttcagg

SEQ ID NO: 43840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttagactgcaccttcacctggcgttagt

SEQ ID NO: 43841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttagggattgagactaagcgtgttgaac

SEQ ID NO: 43842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttagttatcttatgctggtcggggtccg

SEQ ID NO: 43843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttatacacacaaccaagaagcaaggttt

SEQ ID NO: 43844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttcagtattcttacacgaatagtgacat

SEQ ID NO: 43845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttcataccgccagagtaatactctccac

SEQ ID NO: 43846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttccaatatttagagtgtgtcgggaagc

SEQ ID NO: 43847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttctcaggcgggttcacgaaatacccga

SEQ ID NO: 43848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttgacgaggaacagcggagtgcgtgtgg

SEQ ID NO: 43849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttgagcgtaagacggactgcagccactg

SEQ ID NO: 43850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttgccaggaacgcagggatactatggtg

SEQ ID NO: 43851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttgcgctcatgctccagcagcgttgtcc

SEQ ID NO: 43852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcctttgtggaatcccccgccttggccgatga

SEQ ID NO: 43853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttttaagggggaatcacacgcaataatac

SEQ ID NO: 43854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttttaggggtggtaaggcgaggtgttcgg

SEQ ID NO: 43855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttttcattggctagagggcacggggagtt

SEQ ID NO: 43856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gccttttcgacatcgcgttggttgcagcgtgt

SEQ ID NO: 43857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaaacagtattcctcgtttcttactagga

SEQ ID NO: 43858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaaacgacagaggcggtccgaagtatcct

SEQ ID NO: 43859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaaataccctactgcccaggggttgggag

SEQ ID NO: 43860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaacagggatcacatggggcattcactcc

SEQ ID NO: 43861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaacatgtccatagagctcttgtattgat

SEQ ID NO: 43862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaaccgactcacgagcctatcattctgcg

SEQ ID NO: 43863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaactcatttgcctggagctagggggccc

SEQ ID NO: 43864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagaatgtggcccgaatgtactgtaagc

SEQ ID NO: 43865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagatgtcggctcatttaattgcgctgt

SEQ ID NO: 43866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagctgagatgggttgcatgttggtggt

SEQ ID NO: 43867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagtacactgttcccgcggcggtcctgg

SEQ ID NO: 43868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagtcctaccgtgagagctgggcgcgtg

SEQ ID NO: 43869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagtcttgtacgtaacgctttaacacaa

SEQ ID NO: 43870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaagtgcatataagttcaacgggtctgcg

SEQ ID NO: 43871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaatggggaaggggattccgcctgcgagg

SEQ ID NO: 43872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacaacgaatgcgtttaccctcattcctc

SEQ ID NO: 43873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacaatcgcacgggagaaaggttgctcgt

SEQ ID NO: 43874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacaatgatcgtgagatcgagttatacac

SEQ ID NO: 43875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacaggcacatattgcgctccatttgcac

SEQ ID NO: 43876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacagggaggtgtcatggcacgtcggaag

SEQ ID NO: 43877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacagtgtggaataagatctatctacatg

SEQ ID NO: 43878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacatttctattagacaccgcggcggtcc

SEQ ID NO: 43879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaccaacggacaaatctgagtgcgactgc

SEQ ID NO: 43880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacccgtggggccgttggttgacacgccg

SEQ ID NO: 43881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaccgcattaccggacatgatctcgttac

SEQ ID NO: 43882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaccgcttaaacgtctctctacggagcgg

SEQ ID NO: 43883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgctcccgccccggctatagcgggatg

SEQ ID NO: 43884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgctgcccgggattatggcagttccgg

SEQ ID NO: 43885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacggcaggcaggagtcactgcattgtcg

SEQ ID NO: 43886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacggggtgcatgtcgccgttggatcgga

SEQ ID NO: 43887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgggttgcagactccacgcccgggttc

SEQ ID NO: 43888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacggtttcaggtagccagcatctctgcg

SEQ ID NO: 43889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgtcagttggtgatctccagtaattgg

SEQ ID NO: 43890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgtggagcggcctttatgtctaattgg

SEQ ID NO: 43891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgttatgaccgtaactcaacgaaccgt

SEQ ID NO: 43892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacgtttagtattggcgggtgtggtctgg

SEQ ID NO: 43893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactacaacctcgacgggcctcaagtccc

SEQ ID NO: 43894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactattgacaagatggctcttgggatca

SEQ ID NO: 43895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactcagatcctctcgcaaccatcgagcc

SEQ ID NO: 43896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactcgagcgttgcagcggctgctggcat

SEQ ID NO: 43897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactgagcgacttgccccgcgcttcaggc

SEQ ID NO: 43898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactgatgttgagtgccacgcttgggttc

SEQ ID NO: 43899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactgcgctgacgatctagcgggggtgcg

SEQ ID NO: 43900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactgcggggcatatgtggtgaaaccgtg

SEQ ID NO: 43901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacttctccgctttagtgatacagtgagt

SEQ ID NO: 43902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacttgcgtagtaccggcttgtcctctac

SEQ ID NO: 43903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaacttggctcggccattccgttagaccgc

SEQ ID NO: 43904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaactttggtgacccgtcttaggccctgta

SEQ ID NO: 43905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagaataccagcacgcacgctaacctgcc

SEQ ID NO: 43906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagacactgccaccttatctgattcatgg

SEQ ID NO: 43907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagagcacgacaacacgtaggtagcatta

SEQ ID NO: 43908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagaggcagatgtcatgtgccgggttgtg

SEQ ID NO: 43909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagaggtggggacctggcaggcggcgtgc

SEQ ID NO: 43910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagatcgtacaatgagactctgggtcact

SEQ ID NO: 43911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagatgacgacagccctagttgcgactag

SEQ ID NO: 43912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagcgctccccgcatacgcattagtaccc

SEQ ID NO: 43913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagcggtactggcgtcattctctcctaag

SEQ ID NO: 43914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagcgttctctcctcgatcatgctgtacc

SEQ ID NO: 43915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagctaagcgaagtttttgtcgcttcgtt

SEQ ID NO: 43916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagctaggatgttatttgcgcatcggtgt

SEQ ID NO: 43917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagctcacggcttggacaaagtatgttgc

SEQ ID NO: 43918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagctgcgagcgcaatttttcgtagacgc

SEQ ID NO: 43919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagctggtctagtgtaaacactgagccga

SEQ ID NO: 43920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagctttagacatagctaagtggatcacc

SEQ ID NO: 43921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaggacgctaggttgcacagtgtcacccc

SEQ ID NO: 43922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaggcaggtgcatgctaagtcacatacct

SEQ ID NO: 43923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaggctgcagtgtagagacacacctacgt

SEQ ID NO: 43924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaggggtagatacgttctgttgaccggaa

SEQ ID NO: 43925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagggttagtgcggggtaggtgcgcgagc

SEQ ID NO: 43926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaaggtcctccccgtgctatttttggcgtc

SEQ ID NO: 43927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagtagctccagcccagctcccgcacgta

SEQ ID NO: 43928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagtcagtgtagttagctccccgacggag

SEQ ID NO: 43929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagtcattgcacagtttacccaacttgcc

SEQ ID NO: 43930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagtgagtgactggggttcgtccgggctc

SEQ ID NO: 43931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaagttccatgctgttgtgctctggaccgt

SEQ ID NO: 43932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaataccgtgtcatgacatgcagatggtcg

SEQ ID NO: 43933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatagagggatattatcgatctactcctt

SEQ ID NO: 43934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatagccgatgttgcaaatctttacgggg

SEQ ID NO: 43935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatccaacacctacaggacacccctcttg

SEQ ID NO: 43936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatcctggcgggcaatcgtccgacgacat

SEQ ID NO: 43937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatctcgaaccaaaccgtgctgctgtcat

SEQ ID NO: 43938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatctgcacttcagttttgttcaccgctt

SEQ ID NO: 43939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatgcatggcagttcagtgcgtgactatc

SEQ ID NO: 43940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatgcatgtataagggcgaatgtggggcg

SEQ ID NO: 43941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatgcctaagcgtgctagaagaggacagc

SEQ ID NO: 43942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatgcggcttaaatttgctgcgtgtccgg

SEQ ID NO: 43943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatgcgtcgggcaaatcggagtgcaggga

SEQ ID NO: 43944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatggcgggcagtcctccccggcccgttg

SEQ ID NO: 43945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatggtacggcatacgggagtttgcaccc

SEQ ID NO: 43946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatggtccgcctggcaactctttaagtac

SEQ ID NO: 43947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatgtgaagatagacttagccgtgtaggc

SEQ ID NO: 43948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaattagagcaaccatgcataatgtgctcg

SEQ ID NO: 43949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaattggggtggtgtgcgggttattttgta

SEQ ID NO: 43950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaatttgcttcagccgcgtcatctccattt

SEQ ID NO: 43951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacaaaggtcctgcattggtcaaaggtatc

SEQ ID NO: 43952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacaaggcgacagctcaacttccctcgtca

SEQ ID NO: 43953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacaatgaggcaggagtttctgggtatgct

SEQ ID NO: 43954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacaattgccatcgtggtgtgaacaacgtt

SEQ ID NO: 43955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacacaaagtgtttatctaaaatgcgggtt

SEQ ID NO: 43956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacacaaatcgggaatttgagggtcttaaa

SEQ ID NO: 43957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacacaccttcaatagcaagcgtaggcgcg

SEQ ID NO: 43958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacacacgtcgaggcaggcacgtagcacac

SEQ ID NO: 43959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacacaggtaggtacaccgccgaattcttg

SEQ ID NO: 43960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacacgttcagcggccttaggctggtcacg

SEQ ID NO: 43961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacactttggcatgtgcaggggtgttttta

SEQ ID NO: 43962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagacacgtgtcagcgcactagcgaggg

SEQ ID NO: 43963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagaccaattcttgcatgcggccctgcg

SEQ ID NO: 43964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagatagtctataaccgacagtaactcg

SEQ ID NO: 43965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagcacaaaaaggtgtattcagaccatg

SEQ ID NO: 43966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagcgaaatggaggatcctgggtcagca

SEQ ID NO: 43967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagcgactggtgaagccttttcaaggtc

SEQ ID NO: 43968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagctcggtgcgactctgagccccggcg

SEQ ID NO: 43969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacaggaggagtcaaaccgtggccggtctg

SEQ ID NO: 43970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacaggtttcagaccaagcgacgtcaggtg

SEQ ID NO: 43971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacagttgtccttcttcttgggaggtggtg

SEQ ID NO: 43972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatacaacttggcgtgttgtagacaatt

SEQ ID NO: 43973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatacggggtgccacaaccacttgcccg

SEQ ID NO: 43974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatagcgcggtacccggcacgtgttctt

SEQ ID NO: 43975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatatggcacatacactggctatgtcac

SEQ ID NO: 43976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatcagtgcagagcgttctctttgatcc

SEQ ID NO: 43977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatccgtcttgaacgtttaaggggaacg

SEQ ID NO: 43978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatcgaagggataagcacccccagccgt

SEQ ID NO: 43979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatctcggagtacacggagccagcgggg

SEQ ID NO: 43980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatgcagacatacccatggtataccccg

SEQ ID NO: 43981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatgcagttgaatacggttctcccgtgt

SEQ ID NO: 43982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatgccgtcagggcgcccgggatgcggg

SEQ ID NO: 43983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatggtctatatttgtccagcgggggtt

SEQ ID NO: 43984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatgtaagtttgaaaaatcaatctttga

SEQ ID NO: 43985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacatgtttaatctttggtgcgtggaaagt

SEQ ID NO: 43986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccacaatgccctgccgagtcatacgctc

SEQ ID NO: 43987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccacacggatggatccacggccatggca

SEQ ID NO: 43988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccagcatgtctgcctcgattcgtatcgt

SEQ ID NO: 43989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccagcttgtgtgccgcagtttggaccgc

SEQ ID NO: 43990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccatgtccggagatggcgggttattact

SEQ ID NO: 43991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacccacgcataatcctcccgacgacccgt

SEQ ID NO: 43992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacccacgcggatgtttacttgttaggagt

SEQ ID NO: 43993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacccccgacagctcccttgcgtgttgttg

SEQ ID NO: 43994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccccctcaaatggaggccacctacttga

SEQ ID NO: 43995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccccgacaggcgaacgtctacccggcgt

SEQ ID NO: 43996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccccgctcctgccgacttcagggcgtgc

SEQ ID NO: 43997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacccggactcttggcactatggtagttct

SEQ ID NO: 43998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccctggctcttcttccgatgactcggca

SEQ ID NO: 43999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgacagaacgtccgaggatgcgggttt

SEQ ID NO: 44000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgacccaacactagaccgatcaggtgt

SEQ ID NO: 44001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgactgcccgcaggataccgttgtagg

SEQ ID NO: 44002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgatgtcggtgattttttaggatatgt

SEQ ID NO: 44003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgcgtagtactgacactttcattccta

SEQ ID NO: 44004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgctccatctcaggatctagaccactc

SEQ ID NO: 44005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccggccgttcgctgcttgtgtttgggga

SEQ ID NO: 44006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccggcgaggggctctacgaatgaacgcg

SEQ ID NO: 44007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgtattgcactgctttaatttggattt

SEQ ID NO: 44008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccgtgagttcaaggtgactgctgcgagc

SEQ ID NO: 44009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacctcacatgggcgcttaaattcttctgg

SEQ ID NO: 44010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacctgatttactcctcgggagccggggca

SEQ ID NO: 44011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacctggcccaaggaaccggcagtttgcca

SEQ ID NO: 44012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacctgggtccaaatcgatgtctgggctcg

SEQ ID NO: 44013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacctgtgtccagcgtccgccgttcctttg

SEQ ID NO: 44014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccttctccccaaagttagtaatcattgg

SEQ ID NO: 44015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaccttgacatcgaaatagcgtctcttaat

SEQ ID NO: 44016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgaactgacacgaagtcccacgtgggca

SEQ ID NO: 44017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgaaggcgcgctaggggaacgaggggac

SEQ ID NO: 44018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgacgggtaggatctgcaaaactgtgcc

SEQ ID NO: 44019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgactgcggcgagagatcttcgtgtcgt

SEQ ID NO: 44020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgagaccaaagtgtgcggacatagcagc

SEQ ID NO: 44021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgaggaccctactcattgttcgtgggct

SEQ ID NO: 44022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgaggccaaaggctgcacctggcggctg

SEQ ID NO: 44023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgagggagtcagactggagaggcaatat

SEQ ID NO: 44024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgatagactgtggcggcaagtttgcttg

SEQ ID NO: 44025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgatcgactcattcgcctcctcgatgct

SEQ ID NO: 44026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgatgcacctagcaatgccgtgcacacc

SEQ ID NO: 44027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgcaccgaaggaaaattactagtgtccc

SEQ ID NO: 44028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgcacgactttggtttgggccttgtata

SEQ ID NO: 44029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgccgcatgcgattgactctatgcgcta

SEQ ID NO: 44030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgcggcacgtacgggcaatgtggtccgt

SEQ ID NO: 44031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgcgtgtagtgacatcattcgcagcagc

SEQ ID NO: 44032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgctggccaatccggctgtaggtcgttc

SEQ ID NO: 44033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgctttaaatacggaccccctagccctg

SEQ ID NO: 44034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggagcgactggtttcctaccggcaccg

SEQ ID NO: 44035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggatctagaaatctgccgcagcatacg

SEQ ID NO: 44036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggatgcgaggtggggatagcgcctggt

SEQ ID NO: 44037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggcatctgttgaccggcacacgcaggg

SEQ ID NO: 44038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggcatgatgactcagtcgggtaccgca

SEQ ID NO: 44039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggcttggggagggttaggtcggatagt

SEQ ID NO: 44040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggctttgtctggaacgggattgtagtg

SEQ ID NO: 44041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgggaaaaacgtatcatgaccgtacgga

SEQ ID NO: 44042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgggaaaggtactttttgccctacacca

SEQ ID NO: 44043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgggagcgactgtcgatcttttccgacg

SEQ ID NO: 44044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgggctgaacgtgaggttacgcgggtcg

SEQ ID NO: 44045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggggggcttgcatgaagttggcctcac

SEQ ID NO: 44046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgggtatcccggcctccgtggcgaaatg

SEQ ID NO: 44047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggtaaccgatccacgatgccaacggcg

SEQ ID NO: 44048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggtcaatcgatccttgtgttggcaccg

SEQ ID NO: 44049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggtcttgcggtgatcctcgttatggcg

SEQ ID NO: 44050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggtgctgatggtaaggtgtaggattaa

SEQ ID NO: 44051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggtgtacattctttgcgcaggcaggcc

SEQ ID NO: 44052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacggtttcgacgttctcgccgggaaggca

SEQ ID NO: 44053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtaaacagatacctggtatagcgacga

SEQ ID NO: 44054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtacgaaagggagtgggctgtgttttg

SEQ ID NO: 44055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtacgaatttggtattctgcgttgagg

SEQ ID NO: 44056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtagcggctcaaagaacgtacaactgc

SEQ ID NO: 44057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtctatcttatgtggcctgctgagatt

SEQ ID NO: 44058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtctttcgcttacacctttctaatccg

SEQ ID NO: 44059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtgcgtttcgtactggggaacctgccc

SEQ ID NO: 44060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtggaacgactgtgcatcccggctcgg

SEQ ID NO: 44061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtggaagtggggaggactacagcagtt

SEQ ID NO: 44062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtggatgcgactatgcaatccagcacg

SEQ ID NO: 44063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgtgtaggtgccgggcaggataatcggg

SEQ ID NO: 44064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgttatgctgcggcgatgttggtcgggc

SEQ ID NO: 44065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgttctgttccctcgcgattaagatggg

SEQ ID NO: 44066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacgttgaactctgcagggcttcgtacgcg

SEQ ID NO: 44067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactaaccaggcccggaaagatgtgttacg

SEQ ID NO: 44068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactaacgtttaatcggtcatagccaacga

SEQ ID NO: 44069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactaagattgaggtccgtcttcgttgggc

SEQ ID NO: 44070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactactcagcttatctgttggcgtgacgt

SEQ ID NO: 44071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactagaggcttttaattgatgatcccaga

SEQ ID NO: 44072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactagcaaacggcagttcagaccccgcct

SEQ ID NO: 44073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactagcctgggctgtgaagacactgtccc

SEQ ID NO: 44074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactaggccatggaaaccctattgaactcg

SEQ ID NO: 44075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactagggtagtagtcgggtcgtgattaag

SEQ ID NO: 44076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactcatagtagccgatgcacagaaagtgg

SEQ ID NO: 44077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactccacaacattatatatcgcgtcgaga

SEQ ID NO: 44078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactccgaaccggtctcctactctgcatct

SEQ ID NO: 44079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactccgcgcagatttagtcggcggttgat

SEQ ID NO: 44080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactcgatgtctggatattggactcatagc

SEQ ID NO: 44081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactcgattgctgttcagtttgggtggggt

SEQ ID NO: 44082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactcgtggcgggacgattcctgggggctt

SEQ ID NO: 44083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactctcgggatatgtgcttgggtggtttc

SEQ ID NO: 44084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgaagtttgcagctcattccgtctggt

SEQ ID NO: 44085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgagacaacggttcggcgtgaggtcct

SEQ ID NO: 44086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgatgtgaaattttaggcgaaacggag

SEQ ID NO: 44087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgattcccacacgttcgactggcctat

SEQ ID NO: 44088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgcaatcaggcggccatcatctaattg

SEQ ID NO: 44089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgcgctcggtcattgaccggtgtgtga

SEQ ID NO: 44090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactggcactaggcgcaagctactacttcg

SEQ ID NO: 44091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgtaagccgtccattgtttgggtctgg

SEQ ID NO: 44092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgtcaacgccacaaacctgtctcactt

SEQ ID NO: 44093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgtctacaccacgagtgaacgcccggg

SEQ ID NO: 44094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgtgggcgcgggtgacctagtgccgcc

SEQ ID NO: 44095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgactgttatgtttggcgggcgaggattgac

SEQ ID NO: 44096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacttcacttcggtccctgccttgtggttc

SEQ ID NO: 44097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacttcagacgtgacaccggtggcggtggg

SEQ ID NO: 44098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacttgatggatctatttctcgtctgtttc

SEQ ID NO: 44099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgacttgtaaagctccggttcggcaatttcg

SEQ ID NO: 44100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaaaccaaactcttacatcgtctgcctc

SEQ ID NO: 44101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaaacgtgtaattcgttactgatgagcg

SEQ ID NO: 44102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaaatcagtgcaacagtttcagcgatct

SEQ ID NO: 44103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaacatcttgtcgccagcaaccagtacg

SEQ ID NO: 44104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaacggggggacgcagtcagccaagagt

SEQ ID NO: 44105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaactagctgccaccacacaggcctctg

SEQ ID NO: 44106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaagcccaacatgtgatctcactttgtt

SEQ ID NO: 44107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaataccgggccaaaactgataagccac

SEQ ID NO: 44108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaatgcgcgcctactcttttgagttgtt

SEQ ID NO: 44109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagacagacaacgacagcggttttggatac

SEQ ID NO: 44110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaccaaagctggattcccacagggcact

SEQ ID NO: 44111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaccgattgggctcgtatgcttctgtgc

SEQ ID NO: 44112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagacgcatcacgcacagcgcttgggacca

SEQ ID NO: 44113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagacgggcgtttgacatgggttcgctttg

SEQ ID NO: 44114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagacgtaatagtgcaagctcgtgaacctt

SEQ ID NO: 44115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagacgtgaacgcacaacctgagttgcctg

SEQ ID NO: 44116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagactaacacaatagtcgggctagtctga

SEQ ID NO: 44117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagaattcaacttaacatctactgccgg

SEQ ID NO: 44118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagcagatcgtgggttcttcgtgggtgt

SEQ ID NO: 44119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagcagtcgtcacgtaaccgggtgtatg

SEQ ID NO: 44120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagcccgaatcgccctaatgttcagtga

SEQ ID NO: 44121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagcggaaggggttatccagcgacgagg

SEQ ID NO: 44122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagctcacatttaatacgggggtcggcg

SEQ ID NO: 44123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagcttaaaggtttgtgcaacattcgta

SEQ ID NO: 44124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaggagacctcggattcatgggcacagc

SEQ ID NO: 44125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaggcctagttgctgctcttatcgctcg

SEQ ID NO: 44126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagggcgtagtgtagcaacttgggcacg

SEQ ID NO: 44127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaggggcctgaataaccgcggggtcata

SEQ ID NO: 44128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagaggtggaggcgattgggcctgtggctg

SEQ ID NO: 44129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagtaccggggcacagcaaaacggtggg

SEQ ID NO: 44130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagagtcttatgcaaacgagtcttgggtgg

SEQ ID NO: 44131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagatagcctggagcaacgttagaggccgc

SEQ ID NO: 44132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagatagttgaagcacacctacatcgtgga

SEQ ID NO: 44133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagatatgtcgatactaatagacgattacg

SEQ ID NO: 44134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagatcaccgtaccatgcagcgacggggag

SEQ ID NO: 44135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagatggcgccgaccgttcactaggttttg

SEQ ID NO: 44136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagattggttcctgatccaacgtcacgcgt

SEQ ID NO: 44137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcaactatccaagtatggtacacttttc

SEQ ID NO: 44138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcaaggagactctccttcgtggttacaa

SEQ ID NO: 44139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcagaggtgcatttgaagcggattcttc

SEQ ID NO: 44140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcagctcgtcgcgtttcggatccggccg

SEQ ID NO: 44141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcaggatatcatctgttattatgacata

SEQ ID NO: 44142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcaggtcatcggcgtccaggtcattaag

SEQ ID NO: 44143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcatcccgaggggacaaggctgtacttg

SEQ ID NO: 44144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcatgtctcacgttggtgcgtcgttgtc

SEQ ID NO: 44145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagccacgcttcctttttacggtgcggctg

SEQ ID NO: 44146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagccggggaaggcaagcgctgagactcgg

SEQ ID NO: 44147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcctttgcatgcaagtggacgctttcga

SEQ ID NO: 44148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgaattacacaagggttggatcgtatt

SEQ ID NO: 44149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgaatttgcgaccgaagcagggcctgt

SEQ ID NO: 44150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgacgaggttacatagggcgtccgacg

SEQ ID NO: 44151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgaggtatgtcaatggctgcggtgttg

SEQ ID NO: 44152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgatcgattgggatccaccgaggcagc

SEQ ID NO: 44153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgcagatcgcaccggtcttcggcttcg

SEQ ID NO: 44154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgccacaggggacgggattcggttgct

SEQ ID NO: 44155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgccggggacgtggcgaggctggtagc

SEQ ID NO: 44156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcggatagtgggtgttgcttttcgccca

SEQ ID NO: 44157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgggagagagcggtaagttactggctc

SEQ ID NO: 44158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgggagagttttgggttggacccattc

SEQ ID NO: 44159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgggttgcgtggcaaattagggtgagg

SEQ ID NO: 44160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcggtaccagttcggggactaggctatc

SEQ ID NO: 44161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcggttacggcagcgacgcggttgccat

SEQ ID NO: 44162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgtaggcttgcggacgcaacacacctt

SEQ ID NO: 44163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcgttctctcctaatgataaaaggttcg

SEQ ID NO: 44164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagctaattcaagggtcagttgattggggt

SEQ ID NO: 44165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagctacggcaagggggcggctgacggcta

SEQ ID NO: 44166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagctagtaactatccttggcttctgtcca

SEQ ID NO: 44167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagctcagacccgaccctgtgatgtcctac

SEQ ID NO: 44168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagctgggtacactggatcattggggaagt

SEQ ID NO: 44169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcttcaaggcacggcttatctgccatcg

SEQ ID NO: 44170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagcttcctcaattcttgccactaagggac

SEQ ID NO: 44171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggaacggagcggataccacgcagcctgt

SEQ ID NO: 44172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggaagacagcacacaacatcattcggac

SEQ ID NO: 44173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggaagccactctcccaccacgctagtta

SEQ ID NO: 44174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggaaggccagtggcgtaatgcaatggtg

SEQ ID NO: 44175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggaatgggaaggaaccctttattgttgc

SEQ ID NO: 44176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggagaagccatcgcgtctatgcagtagg

SEQ ID NO: 44177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggagacgctctggaggacacatagcctc

SEQ ID NO: 44178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggagatggcgccagcggtatagagtgcg

SEQ ID NO: 44179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggagggggttgaggatgtagtactcgtg

SEQ ID NO: 44180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggagtctccatggaatacgtgtcgatcc

SEQ ID NO: 44181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggataaagcgctgttctaactgggccgc

SEQ ID NO: 44182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcaaaagtcgagggcatgatgagcgtt

SEQ ID NO: 44183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcagaagaagtgaccgtcggggtcccg

SEQ ID NO: 44184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcaggagcctattggtcagtaggtcgc

SEQ ID NO: 44185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggccagtgtggatgcccggtctgccctt

SEQ ID NO: 44186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggccccttcatgtccgctcattgtttta

SEQ ID NO: 44187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggccggggtatgttagagagtatttctt

SEQ ID NO: 44188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggccggttgcagtcgtgtgatttggaag

SEQ ID NO: 44189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcctgccaagggcgatcggcatgtttc

SEQ ID NO: 44190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcgacggtctagacgtgtcttctgcgt

SEQ ID NO: 44191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcgagtggcgctggtgggctgatatcc

SEQ ID NO: 44192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcggacttcgccccgggccagcgtcgg

SEQ ID NO: 44193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggcgtgcacggtccgttgatagggaagc

SEQ ID NO: 44194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggctcgacccggctggacgcgctgggtg

SEQ ID NO: 44195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggacggtggtctgactctctgtctcgc

SEQ ID NO: 44196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggagaacagatcaaaatagggaggggc

SEQ ID NO: 44197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggaggaggccaggcggggtggattgtc

SEQ ID NO: 44198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggagtgctgggcaacgaggtgaggcgg

SEQ ID NO: 44199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggcactttggctttccggggggtcata

SEQ ID NO: 44200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggcggactattccctacacattcctgc

SEQ ID NO: 44201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggcggaggagggctcattacgaaatga

SEQ ID NO: 44202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggctagctgcgtaggcattaggactga

SEQ ID NO: 44203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggctcactcgtgacctgcggttcgtat

SEQ ID NO: 44204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggctctctgtccgcgacttgaagctgg

SEQ ID NO: 44205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggggcctttacctgtttgcggtttcgag

SEQ ID NO: 44206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggggaagcaagcttgtagcgagctgca

SEQ ID NO: 44207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggtattactatatgcaccccggtaacg

SEQ ID NO: 44208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggtcgtcgactccgttatcctgttgcg

SEQ ID NO: 44209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagggtgctggtaactggtatttttggagg

SEQ ID NO: 44210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtaaacgcgtcatgtcagctgccaata

SEQ ID NO: 44211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtagcaggtccgtatttctgccggtcg

SEQ ID NO: 44212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtataggaggagtggatgtgcacctag

SEQ ID NO: 44213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtatgggcggggttataagggtggcaa

SEQ ID NO: 44214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtcagttgtgctatctcgatgcacttc

SEQ ID NO: 44215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtgaacttcagacccgggaagaggtgg

SEQ ID NO: 44216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggtgaggagttccggtttgatagggtgt

SEQ ID NO: 44217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggttcgagatgcgtgtctgaggacccat

SEQ ID NO: 44218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgaggttgcacgtcagcagtgtcggttgata

SEQ ID NO: 44219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtaacgcggatcctcgtactccggctgc

SEQ ID NO: 44220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtacgtcatgtctaactgcaacccctcg

SEQ ID NO: 44221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtagtagaacaccggtagggacgtttgc

SEQ ID NO: 44222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtatatcggggtaaggctttgcatacgg

SEQ ID NO: 44223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtatcattgaccgtattcgatgcgctgc

SEQ ID NO: 44224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtattcgagaagcggtcacacctggcca

SEQ ID NO: 44225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtattggatgcgagactggtccaggccc

SEQ ID NO: 44226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtcaggcggaggagataagaatgtacac

SEQ ID NO: 44227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtccagctctgaatatgttcagctcgcg

SEQ ID NO: 44228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtccatctcccaatgttccgggacgcgg

SEQ ID NO: 44229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtcgacctgttcgctatccgcctccgtt

SEQ ID NO: 44230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgaccacgcatctaccctcgttcgaca

SEQ ID NO: 44231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgactaggtgcaccgccggtatacgtt

SEQ ID NO: 44232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgatcctcaagcggtttgcgggtacgc

SEQ ID NO: 44233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgcacgtagcaaatgggctggctaggg

SEQ ID NO: 44234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgcagaccactactgcttcttccacta

SEQ ID NO: 44235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgccaatgccaccgtttgagtagggtt

SEQ ID NO: 44236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgctgtccgttcccctcatgacctttt

SEQ ID NO: 44237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgtaggttgagcagttagagctactcg

SEQ ID NO: 44238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtgtccgagttgatgtcatctttccgtg

SEQ ID NO: 44239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttcaccgcgaccgcttgcaataatgcc

SEQ ID NO: 44240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttcaggcaagggccgatcttgaccgcg

SEQ ID NO: 44241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttccggcagacatgcacaaggctggat

SEQ ID NO: 44242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttcctggctgatcggtgtcacctatca

SEQ ID NO: 44243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttctgtttacagtatgcctcagtccct

SEQ ID NO: 44244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttgatcacgtttgtagcgcgtggcacg

SEQ ID NO: 44245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttgggccggttagcagtagtttcatgc

SEQ ID NO: 44246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtttaagtcggtaactgaggttctacgg

SEQ ID NO: 44247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagtttcgatgctggcaccacggtcacccg

SEQ ID NO: 44248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgagttttgaaaggttagtgggcttgcgtgt

SEQ ID NO: 44249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataaattgccactagagtgactttgctcc

SEQ ID NO: 44250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataaccactcaaatctcgttcatacggtg

SEQ ID NO: 44251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataacctaaggggtctttcttttcctatc

SEQ ID NO: 44252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataaggcaagacacgctgggccgcggacg

SEQ ID NO: 44253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataaggcgcgtaaataatctcacatatgc

SEQ ID NO: 44254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataagttagtcgggcaatttgttcgggcg

SEQ ID NO: 44255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataatgatgttaatgttaccgtagggtta

SEQ ID NO: 44256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataattcgggattatctttcaccttagac

SEQ ID NO: 44257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatacaattaagtataatggtttggccagg

SEQ ID NO: 44258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataccgtggagatcgtctgtgcgatttga

SEQ ID NO: 44259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatacgtccacacgcttgttgcagttgagg

SEQ ID NO: 44260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatactaattgcgcatagttaccgccgtta

SEQ ID NO: 44261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatactgctctctcttgctgcacgtttctc

SEQ ID NO: 44262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagacgtccgatgcggtgtccgggccgg

SEQ ID NO: 44263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagagaccttatgtgcatgccgtatgtc

SEQ ID NO: 44264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagattcgcgaagccgttccgctgccgg

SEQ ID NO: 44265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagcggaagatcagcgttttattagggt

SEQ ID NO: 44266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagcggcacgtcgcctacaggcattctt

SEQ ID NO: 44267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagggcgggtgtttgctgttttcacttc

SEQ ID NO: 44268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgataggggactacgaagatggccgtctgtc

SEQ ID NO: 44269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatagtccattcattgaaagagcataaagc

SEQ ID NO: 44270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatatcagcggcgccgcgtgagcgctgtga

SEQ ID NO: 44271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatatctggcattggacttataggcgcgca

SEQ ID NO: 44272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatatgcttcggcgacagttccgcagtccg

SEQ ID NO: 44273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatatgtgtgcaatatggcaggtacacagg

SEQ ID NO: 44274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatattaattgctgtcctatatttccggtg

SEQ ID NO: 44275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcaatggcgagcataggaccgttacgac

SEQ ID NO: 44276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcacacgttttcctttaccaacacgttg

SEQ ID NO: 44277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcacccggtctggttcatggttgtgcga

SEQ ID NO: 44278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcaccgtatcctcgcactggctacgtgg

SEQ ID NO: 44279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcacgagagctcctgatgtcgtgtcggc

SEQ ID NO: 44280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcaggacgttcgaaccgatcatccgtgc

SEQ ID NO: 44281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcaggggagcgaggctgtgtggactgtg

SEQ ID NO: 44282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcattcagtgtccggacttcgagcccga

SEQ ID NO: 44283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatccacggggcccgcaatctcctgggtga

SEQ ID NO: 44284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcccgataacctgttgcgtgccacgagg

SEQ ID NO: 44285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatccgggatcccggcatcagttccgttct

SEQ ID NO: 44286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatccgtgtaagtcgctttgtgcaccgaat

SEQ ID NO: 44287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcctgggcggtatcccagtgaacctctg

SEQ ID NO: 44288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatccttatgggatactagctccctgtttt

SEQ ID NO: 44289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatccttgtgcgtggaatgagtaaaggttc

SEQ ID NO: 44290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgaagttgcgatttagagaagtcgggg

SEQ ID NO: 44291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgatcacgttttagcgctaatgcccct

SEQ ID NO: 44292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgatcaggattcgcgattcctgcgtcc

SEQ ID NO: 44293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgcgtttttcttgttaacgcgacaatg

SEQ ID NO: 44294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgctttctgaaagagcgcggatgcatg

SEQ ID NO: 44295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcggacgcagtgcggcaccacattgcgt

SEQ ID NO: 44296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcggcatgtactcagtgacgtttggttc

SEQ ID NO: 44297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcggccacccatattgtcgaggcacgag

SEQ ID NO: 44298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgggcagcggtaaatcgcaaccacatc

SEQ ID NO: 44299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcggtgcaaagagtatgcttcccaacgg

SEQ ID NO: 44300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgtcgggaaggggccgcttttgcaagg

SEQ ID NO: 44301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgtgacgcggtagaacatcctattcac

SEQ ID NO: 44302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgtgagattaatctaagtttggtcaga

SEQ ID NO: 44303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgtggtacccagcccctgattagtcga

SEQ ID NO: 44304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgttaccatacttgttgtttgctgccg

SEQ ID NO: 44305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcgttactgtgtgctttatgaggttacc

SEQ ID NO: 44306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctaggcgagaacgttggacggaggctt

SEQ ID NO: 44307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctatatggacgcttttatttgtagttg

SEQ ID NO: 44308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctcacacggtacgtacgcacttcagca

SEQ ID NO: 44309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctcacgtccgagacggacaggaatctt

SEQ ID NO: 44310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctcatgtctcagacccggcattactgg

SEQ ID NO: 44311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctcccgaggttgtgggctacgattctc

SEQ ID NO: 44312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctccgatttagtctcactcgggccggc

SEQ ID NO: 44313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatctgctttgagagtgtagcttatgtctc

SEQ ID NO: 44314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatcttggcagttttgacagactacccagt

SEQ ID NO: 44315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgaaaacccttactggactagtcgtttg

SEQ ID NO: 44316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgaaggacgctgtatcggctccgtggtg

SEQ ID NO: 44317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgaatgggtcaccgggttggctaggcaa

SEQ ID NO: 44318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgacaaaaactcggctctagcgaagagt

SEQ ID NO: 44319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgacagagttgcggatgtttgacgctcc

SEQ ID NO: 44320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgaccgtatgtttccaagggccagttcc

SEQ ID NO: 44321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgaccgtcgccccgcactcgaaggaccc

SEQ ID NO: 44322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgacgatagccgcctgtcccgctcgtgt

SEQ ID NO: 44323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgagaacgctttgagtcagggagtctag

SEQ ID NO: 44324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgagactacaagaaccgaacgtctatca

SEQ ID NO: 44325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgagatggctctgaaagttctcggattg

SEQ ID NO: 44326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgagattgagccgcctccctgctggtag

SEQ ID NO: 44327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgagcggagccactagggagcttgtagg

SEQ ID NO: 44328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgaggttaccgtcgaagagagagtcgct

SEQ ID NO: 44329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgagtacagcaatcccacatctttcgcc

SEQ ID NO: 44330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgatcgcgaggtaccacaagctccatcc

SEQ ID NO: 44331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgattgtcagaatatgtccttgtcgata

SEQ ID NO: 44332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcagcgaacagcttatgtgtcaaggag

SEQ ID NO: 44333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcattaggtggaaggtggtcaacggtt

SEQ ID NO: 44334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgccagtgcgggtgccaccttgccgtag

SEQ ID NO: 44335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcgatcgagttgcctggccgttatcgt

SEQ ID NO: 44336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcgcgggaaggggtgtgagtttggtgc

SEQ ID NO: 44337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcgctgagtcgtgtggcggtcaaacga

SEQ ID NO: 44338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcggggggtgatcctgtagtgttcagg

SEQ ID NO: 44339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcgtgtgatgggactgtttggtttgcc

SEQ ID NO: 44340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgcgttctgacggttggaacgctgcttg

SEQ ID NO: 44341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgctatttacggcctacggattaaagtt

SEQ ID NO: 44342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggacaagcctcggttcaatcgctcact

SEQ ID NO: 44343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggaggggcggccctttcgctaagttat

SEQ ID NO: 44344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggcaaagatggcatgtggctgcatcac

SEQ ID NO: 44345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggcaagcataaaacattttagttccgc

SEQ ID NO: 44346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggcacattcatatatgtcacgttcccg

SEQ ID NO: 44347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggcctccggcagctccgaaaagttcga

SEQ ID NO: 44348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggcggaacatggtttggggaaggggga

SEQ ID NO: 44349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggcggtctaagctggatctgagaaggg

SEQ ID NO: 44350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggctgggcattctgaggaagaggagta

SEQ ID NO: 44351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgggcgttgaccctcaactcggccccga

SEQ ID NO: 44352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgggggggcggttactaccgtgggcacg

SEQ ID NO: 44353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgggtgtgctcatgcttgccacaataag

SEQ ID NO: 44354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgggttgttactgcgatccccatttgat

SEQ ID NO: 44355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggtggcagaatgtcgacgagcggcgag

SEQ ID NO: 44356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggtggccgcaaattacggggctgtacc

SEQ ID NO: 44357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggtggccggctatgtccgactgtttcc

SEQ ID NO: 44358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatggtggggatgtcgatcgacctctggcg

SEQ ID NO: 44359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgtaaccgtcgctgcctcaccgacatgt

SEQ ID NO: 44360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgtagtattctaacgccccacgtattga

SEQ ID NO: 44361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgtccagggcttcggtactacaggtggg

SEQ ID NO: 44362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgtcctggcattgtggatttgccagcgg

SEQ ID NO: 44363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgtgtaccctctcatcacggcccccttt

SEQ ID NO: 44364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgttagttggcctgcaacctcagcatgc

SEQ ID NO: 44365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatgttttattttgcacgctcggacagtat

SEQ ID NO: 44366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattacatgtgcttgatcttacatcctgag

SEQ ID NO: 44367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattacctgtagatgcgtagtagtagtgac

SEQ ID NO: 44368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattacgtgtactgaacgacggagaatttc

SEQ ID NO: 44369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattatgtcgtacttttccttgcgatttag

SEQ ID NO: 44370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattcaaattgccatcgtcgcgtcctactt

SEQ ID NO: 44371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattcgtcgatcttgaacggttgtggagtg

SEQ ID NO: 44372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattctagtccgggacgtaaggtgtgcatg

SEQ ID NO: 44373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattctcccaggttccatggcttgcaccgc

SEQ ID NO: 44374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattcttgctcttttgcttcgaggttttcg

SEQ ID NO: 44375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattgagtccaacaccactcttacgtctgt

SEQ ID NO: 44376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattgcggaagtgctgatctagttcgagta

SEQ ID NO: 44377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattggaagcggctagattattcggttagt

SEQ ID NO: 44378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattggagggtagcgtccttagcgtagtaa

SEQ ID NO: 44379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattggcaatctttacgagtcacgtccact

SEQ ID NO: 44380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattggggaatcgcgggattgattcatctc

SEQ ID NO: 44381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatttacgattccatgggtacgtatacagc

SEQ ID NO: 44382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgatttgaacctatcccccagtctacaaccc

SEQ ID NO: 44383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgattttggttctgtcaaagtgtcgaggcca

SEQ ID NO: 44384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaaaacacctgcgttacatttgcagcga

SEQ ID NO: 44385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaaacatcatagactgcattcgttgcct

SEQ ID NO: 44386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaacccaggcgtcggatgaaatcgcagg

SEQ ID NO: 44387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaaccggagcgttcggttagtgtcggcg

SEQ ID NO: 44388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaacggggccgtataatcgtccgacatg

SEQ ID NO: 44389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaactgagcattacgccttgagcacttg

SEQ ID NO: 44390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaactgcagcggagacagagggtcttgc

SEQ ID NO: 44391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaacttttcctcctactccggcccgttc

SEQ ID NO: 44392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaagccgcagggttactgtgtatgcaat

SEQ ID NO: 44393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaaggccgcggcaaccaaggttaatccg

SEQ ID NO: 44394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaagtaagacttgtactggcaatgaagg

SEQ ID NO: 44395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaatggatatgtgcgcggtagcgatact

SEQ ID NO: 44396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaatgtgccgagcgcgttcgtgttgtat

SEQ ID NO: 44397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaacacagcaccggttccacaggcagggt

SEQ ID NO: 44398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaacacggttagtttagagttacgtgctg

SEQ ID NO: 44399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaccggctttctgctattgggaccgccc

SEQ ID NO: 44400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaacgggtgcggcacatccgatcagtttg

SEQ ID NO: 44401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaacttcacccgctcgggtacgtggcacg

SEQ ID NO: 44402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagacgatcaattgtaggttaggctcgg

SEQ ID NO: 44403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagactcacgtagtgttgtatcggtttc

SEQ ID NO: 44404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagccagcttcacgtgtttactccctgt

SEQ ID NO: 44405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagcgacctagattatctgttcgtgctt

SEQ ID NO: 44406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagctgatccctgagcggtgggaggttc

SEQ ID NO: 44407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagggatgcctagtgtttaccatcagtg

SEQ ID NO: 44408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagggcatctaacactgcggtgtcggtt

SEQ ID NO: 44409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaggggtaggcggcgagcatccgagggg

SEQ ID NO: 44410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagggttgacttcatcattccacgcctc

SEQ ID NO: 44411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaggttcatgtgcatcggtcgggtcttg

SEQ ID NO: 44412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaaggttttgattaggtagtgaatccgtg

SEQ ID NO: 44413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagtcgtacgaagaagaaagtcttatcc

SEQ ID NO: 44414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagtgattggccccggcagcgaattcat

SEQ ID NO: 44415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaagttcaaggtgggcctggtctgcatgc

SEQ ID NO: 44416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaataaggtgccgaggacttgaaggccgt

SEQ ID NO: 44417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatacggagaacccgtgagagtatgcga

SEQ ID NO: 44418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatcattagctggagaacatcccgggcg

SEQ ID NO: 44419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatcgcaacgctataacacttaaatccg

SEQ ID NO: 44420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatgaactcgttcgcgggacatcggtct

SEQ ID NO: 44421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatgacggtccatcaaccccagggctgg

SEQ ID NO: 44422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatggagaacgctttgtttgaactgatg

SEQ ID NO: 44423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatggatccacgaatcgtaaggcgagcg

SEQ ID NO: 44424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatgtattacaggactaccagctcgggg

SEQ ID NO: 44425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaatttaccccggccatcctcgacttctg

SEQ ID NO: 44426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacaaagaacggtgtctagtttcggatgc

SEQ ID NO: 44427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacaatctcgaagaccgccagcgtttgtc

SEQ ID NO: 44428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacacacaaaagtcgggttcatcgccgca

SEQ ID NO: 44429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacaggctcgtttcccgacttgtggaccg

SEQ ID NO: 44430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacagggcgagctgatgtaccttggcgga

SEQ ID NO: 44431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacagggtcggcgagaaccggcacgtcgc

SEQ ID NO: 44432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacagtggccatggaagtaatcgtcgggc

SEQ ID NO: 44433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacatcgcttccatttcaattgttacatg

SEQ ID NO: 44434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacattcccttcgatctcgataggcacgg

SEQ ID NO: 44435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacccctacaggggggatgggtacaccgc

SEQ ID NO: 44436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacccggccagaaatagcctagaatcgga

SEQ ID NO: 44437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaccctatgtatctcagcccatgcggccg

SEQ ID NO: 44438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaccgcttttgccaggttctcgaggatca

SEQ ID NO: 44439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaccgtcctgagagctattgtacgagaat

SEQ ID NO: 44440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaccgtgaaggacggcggctgagttgggg

SEQ ID NO: 44441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacctagctttcgtggtgttcatcgctcc

SEQ ID NO: 44442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacctagttaatcccaattgggacggttt

SEQ ID NO: 44443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacctcgcttgttcgaagtgtaggtcctc

SEQ ID NO: 44444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacctgcggaaaccgttcgggcctgaatc

SEQ ID NO: 44445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacctgtgctgtaaagtcagtacggagac

SEQ ID NO: 44446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacctttaaatgctgtcaacgtgtctacc

SEQ ID NO: 44447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgaaggtgattttcggttgtcctttct

SEQ ID NO: 44448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgagttagcaactgggcacttgaattc

SEQ ID NO: 44449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgcgggcgatgatggtaacctgggcca

SEQ ID NO: 44450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgctcgcggacagcgtaacggagcggg

SEQ ID NO: 44451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgcttcgtcggccataatgtgtgctct

SEQ ID NO: 44452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacggaagtaaattaaacacaacgggtcg

SEQ ID NO: 44453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacggcagtcttgggagattgcgatactc

SEQ ID NO: 44454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacggcgttaattacatgcacccagatgc

SEQ ID NO: 44455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgggatagtcggacctgatcgaagaaa

SEQ ID NO: 44456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgggctatcacgctagactctcggtcg

SEQ ID NO: 44457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgggtggaggaggaggtcccgttcgaa

SEQ ID NO: 44458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgtctgtgatgcgctggctttgttcgg

SEQ ID NO: 44459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgtggcaaggttgcaggttgcagggca

SEQ ID NO: 44460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgtgtgatagcgtagttttcaatcgcc

SEQ ID NO: 44461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgttacatggcgttacgtttactagtt

SEQ ID NO: 44462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacgttggtgcgggagtcataaatccacg

SEQ ID NO: 44463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactaagtgtgggcgcactcccctctggc

SEQ ID NO: 44464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactccaggtaggcgttgcagtttgcttt

SEQ ID NO: 44465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactctgtactctgacgcttccccgttta

SEQ ID NO: 44466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactgattcaatcgacctagtcagtggta

SEQ ID NO: 44467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactgcacactcctccgcggtttacgccc

SEQ ID NO: 44468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactgcagggactcccggaaaagtcatcc

SEQ ID NO: 44469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactgcgggaattctcgggaagtacgtac

SEQ ID NO: 44470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcactgggccagaggtatgaccagctagtc

SEQ ID NO: 44471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacttacacaatttacctgtccgcgagat

SEQ ID NO: 44472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcacttgtaacatctctctcggcagtctgg

SEQ ID NO: 44473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagaaggtgctaactttgtggggatgccc

SEQ ID NO: 44474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagacaggggtcatctctttggtacttcc

SEQ ID NO: 44475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagacagggtagggtgtgggatccggcgg

SEQ ID NO: 44476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagaccgagcatgcggcttcgccagctgg

SEQ ID NO: 44477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagaggacgttgttccagcgaggcggcta

SEQ ID NO: 44478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagaggctaccaaatgcatacacgtcagg

SEQ ID NO: 44479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagatcactgggcgaaggtgtgtgaaggc

SEQ ID NO: 44480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagatgaccagggtatggttccggctgca

SEQ ID NO: 44481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagatttcgtttctggcgagggactagcg

SEQ ID NO: 44482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagccgctaagtcctaggcttgaggggtt

SEQ ID NO: 44483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagccgtagggtaccgacaaccatagggt

SEQ ID NO: 44484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagcgtacatcagacggattgggatgcgc

SEQ ID NO: 44485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagcgttcatcgctcttcggacaaggaca

SEQ ID NO: 44486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagcttgaaggtatgtccggtcttgcgct

SEQ ID NO: 44487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggaatttacggcattgtacactggagg

SEQ ID NO: 44488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggacggagcacgtccaaaacgcgggac

SEQ ID NO: 44489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggagtatccccggcatccgcagtaatt

SEQ ID NO: 44490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggagtcaccgtcgaacggacccgaccg

SEQ ID NO: 44491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggatggaatgcgaaatggccgggatac

SEQ ID NO: 44492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggcaagaatcgtgggacatcggggttg

SEQ ID NO: 44493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggcactggcacgagaggtccaccattc

SEQ ID NO: 44494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggccagacgaatgtgaccggcattatc

SEQ ID NO: 44495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggcgacattgatcttccctatatgtag

SEQ ID NO: 44496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggctgggggggtcaatgcaattcgggc

SEQ ID NO: 44497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagggacctgagctcatggcagggcctca

SEQ ID NO: 44498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagggagacgtttaggacccaccatgcac

SEQ ID NO: 44499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagggatttggttatcggactccgtcgtg

SEQ ID NO: 44500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagggcgagtataaccatcgctgaactgg

SEQ ID NO: 44501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggggctggactaacctaatgccggtcg

SEQ ID NO: 44502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagggtcacgagccacgcaccgtgggtac

SEQ ID NO: 44503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggtgacaccgtaattcccttcctcatg

SEQ ID NO: 44504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcaggtgcccaccggtgtacaaacctcctt

SEQ ID NO: 44505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagtcggttcccaggaattgcgataagtt

SEQ ID NO: 44506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagtgaaaaagcgagcaataaacgatgca

SEQ ID NO: 44507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagtgatgcacgagtagttccgctcggca

SEQ ID NO: 44508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagtgcttgttcaggttgatagcgacgcc

SEQ ID NO: 44509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagtttggaacctcctatttcgtctgagg

SEQ ID NO: 44510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcagtttttaaagtcctcagatgcggattg

SEQ ID NO: 44511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatacatcgaacatttaagacatatgacc

SEQ ID NO: 44512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatacgggtaggtgaataccaagccggcg

SEQ ID NO: 44513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatactaacaatcgatgaggcccatacac

SEQ ID NO: 44514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatactttcgctgtcaagccggtgagcgg

SEQ ID NO: 44515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatagttgagccagagggtaacggtcacg

SEQ ID NO: 44516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatcacaccttgtcacctgctctgggtgg

SEQ ID NO: 44517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatcatgcgaggacttcggtagacgacga

SEQ ID NO: 44518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatccaatataggtcccccctcaaggcat

SEQ ID NO: 44519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatccgacgggtttgacaccgcgttggca

SEQ ID NO: 44520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatcggggaaaaaacgtcgccatggaagg

SEQ ID NO: 44521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatcggggcgatcatgcagacagtacctc

SEQ ID NO: 44522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatcttgtatcagaacaggggatcatctc

SEQ ID NO: 44523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatcttttcgattgtgtatatctcatgct

SEQ ID NO: 44524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatgacgacggtgttcttatgcttgcacc

SEQ ID NO: 44525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatgaggtgtgtgtgtggagggcattcaa

SEQ ID NO: 44526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatgcaaagagaactgcggctttgtcagg

SEQ ID NO: 44527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatgcgggtgaactccatttaacattgat

SEQ ID NO: 44528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatgcttaggttctgttcacggggaccgg

SEQ ID NO: 44529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatggactatcgatgcggtgataaagcta

SEQ ID NO: 44530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattaattggtcagtagagccggtcatac

SEQ ID NO: 44531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattacgttcacttcccgaacttatagca

SEQ ID NO: 44532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattcaagaagaaacacggcgggagaacg

SEQ ID NO: 44533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattcctactacgaaacatatagcgagtt

SEQ ID NO: 44534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattcgaggcgttttctgtgtgatcgatt

SEQ ID NO: 44535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattgaaaagtttcctaatcccctctcgc

SEQ ID NO: 44536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattgaatagataggaggaataattagac

SEQ ID NO: 44537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattgcagtgcggatatcagtggtttcgg

SEQ ID NO: 44538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcattggtcttcactgcatggtagactctg

SEQ ID NO: 44539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcatttccattactcggcttcgtctgacgt

SEQ ID NO: 44540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaaaggtctagcccctgccgatagtcac

SEQ ID NO: 44541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaattccctgactgtccgtgttacgtct

SEQ ID NO: 44542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacaaggttcgtgttctcttgagatttc

SEQ ID NO: 44543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacatacacctgcgtgaatcggggttcg

SEQ ID NO: 44544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacccaagaatctacagcttatgagcgg

SEQ ID NO: 44545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacgcgtgaacgtctgctttgatattgc

SEQ ID NO: 44546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacgggtactctggttctttgccaggcg

SEQ ID NO: 44547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacgtcggttctcctgtattttacggca

SEQ ID NO: 44548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacgtgtattgtattttaggctcggttg

SEQ ID NO: 44549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccactgccttatacactcccctccgcccc

SEQ ID NO: 44550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccacttgacggcccttgacaccggggtcc

SEQ ID NO: 44551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagacgtaagataccgggtaggcgagac

SEQ ID NO: 44552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagacttgtcattacctcagctaccgtt

SEQ ID NO: 44553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagagcgatgtcatttgggacggttgcg

SEQ ID NO: 44554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagcaagagtgggtagacgactcgggaa

SEQ ID NO: 44555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagcatgtagcagagcgtcaggtaggtt

SEQ ID NO: 44556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagcgacggaaaggacgaacgatggatg

SEQ ID NO: 44557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagcgacttgagtaggttgtggtacttt

SEQ ID NO: 44558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagcgtgttattatggccggaccaagtg

SEQ ID NO: 44559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaggaaatcgggggtgcgccgggcggtg

SEQ ID NO: 44560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaggcagatggagtgttgatgtaacaga

SEQ ID NO: 44561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaggcggggatcagagtgccttgtcttg

SEQ ID NO: 44562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaggtaacgtcaacgtccggcgggttag

SEQ ID NO: 44563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaggtccatatttgtaccgcgtacgcgc

SEQ ID NO: 44564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccaggtgggaccagaccgtgggttaaggt

SEQ ID NO: 44565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagtaggggcagttgcttgggctaagtt

SEQ ID NO: 44566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagtgcagctatccctaggacccggacc

SEQ ID NO: 44567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagtgctgactcgagtccatgtcaattg

SEQ ID NO: 44568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccagttagtgtccataacatcgttggggg

SEQ ID NO: 44569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatagagtccttccggatgggatccccg

SEQ ID NO: 44570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatagatggcagttcttgatacccgggc

SEQ ID NO: 44571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatataggaggcacgcttccccctctgc

SEQ ID NO: 44572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatcgatcattgcaacatcactgtgagc

SEQ ID NO: 44573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatcggtatggttcggctcaggcccaag

SEQ ID NO: 44574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatcttgattgtcaggacggccaatcgt

SEQ ID NO: 44575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatgactaatcgcgtcgtttctgccaag

SEQ ID NO: 44576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatgcggtcgtgaacgatccctaatgat

SEQ ID NO: 44577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatggctgaactaccttctttagagtag

SEQ ID NO: 44578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatgttaggggttctcacttgtgtccgc

SEQ ID NO: 44579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccatttagtcgggcagagtggaagcacgg

SEQ ID NO: 44580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccaagcccggctcactaatggtcttctc

SEQ ID NO: 44581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccacaaacgctccatgttttagcagtcc

SEQ ID NO: 44582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccactaaccgacgggcccctccgtgggt

SEQ ID NO: 44583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccatccatgcgactttagaagtcacgtc

SEQ ID NO: 44584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccatctcaagctttcgttgttgctagcg

SEQ ID NO: 44585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccatggggttatcatgacgattgggtcg

SEQ ID NO: 44586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccatgtcgaccgtcagcatgatcgcagc

SEQ ID NO: 44587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccattcttccacgtctgcatacggtcgc

SEQ ID NO: 44588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccccacaagtagcatggactgtgaatagg

SEQ ID NO: 44589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccccgctcaactacgaatcgtattcgac

SEQ ID NO: 44590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccccgcgatccattggcacgtcacccttg

SEQ ID NO: 44591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccccgctgtgtgtctcattggtacgtcct

SEQ ID NO: 44592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccctcggctcggctggtgcaatagattg

SEQ ID NO: 44593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccctggcctgatgttgtttggtagtcgc

SEQ ID NO: 44594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccctgtagagaggagcgtcagtgagctg

SEQ ID NO: 44595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccgaccttgtaatacagtcctggggcta

SEQ ID NO: 44596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccgacgcggtgttagttggcactgatgt

SEQ ID NO: 44597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccgccgttcgttcatctgaggacgtttt

SEQ ID NO: 44598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccgctaggcccggtcgagaggtcgacta

SEQ ID NO: 44599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccgctggcattcaccgggcgagtgcgat

SEQ ID NO: 44600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccggacgcgtctcggctcgctacagggg

SEQ ID NO: 44601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccggggtttacatctctttgtgatcgcg

SEQ ID NO: 44602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcccgtcaggtttcgtcgtgggtatggctg

SEQ ID NO: 44603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccctcgatcaggacatcccggccttcgct

SEQ ID NO: 44604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccctctaagccggtgtacgtcggaaatat

SEQ ID NO: 44605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccctgaggtttatgatcctcggccttttg

SEQ ID NO: 44606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaaattcgtatttgggagaatgcaggg

SEQ ID NO: 44607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaacatgtccacacgcattcagcaggc

SEQ ID NO: 44608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaacggtatagctgtagaagacgtcct

SEQ ID NO: 44609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaagctggcattctgtcgccgggcacc

SEQ ID NO: 44610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaaggaagcagtcgtggttgctgcgtg

SEQ ID NO: 44611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgacaaaacggccaccggacactgcgca

SEQ ID NO: 44612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaccaagtgacgtgtggttcgtgaggg

SEQ ID NO: 44613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgagagaccactggacgttttgtgcggc

SEQ ID NO: 44614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgagctggcagtgatgtctgtttctagt

SEQ ID NO: 44615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgaggctgaaccagcgcaggtcgagcgg

SEQ ID NO: 44616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgagtaccactgcatagccaggcgggct

SEQ ID NO: 44617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgagtacgcgagtaagtcatgcaggtat

SEQ ID NO: 44618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgatattcgatgcttaccgggtgtcccc

SEQ ID NO: 44619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgatcgtttcacgcgtgcaattaaggac

SEQ ID NO: 44620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgatggtgaggctatttaccaagatgct

SEQ ID NO: 44621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgattgagggctcaatgtcctgtggagc

SEQ ID NO: 44622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgcacttcatgttcatgatgtacgggat

SEQ ID NO: 44623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgcccgctgtttgtcgctcgatgagctt

SEQ ID NO: 44624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgcctgtagatgaggctaactgagtgtg

SEQ ID NO: 44625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgcgatatcacatagcctctgtaaatcc

SEQ ID NO: 44626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgcggattgcatatggacttgtcttagg

SEQ ID NO: 44627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgctcgagcacgatagatcacgcgcttg

SEQ ID NO: 44628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggaactcgaaatgactgacgcgctctt

SEQ ID NO: 44629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggagctggtacattgacagtcgaacac

SEQ ID NO: 44630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggatgaaagaacggagatccagagcgc

SEQ ID NO: 44631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggcggggggttagtcagtcgttgactg

SEQ ID NO: 44632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggcgtcgttatacttgacaagcatttg

SEQ ID NO: 44633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggcgtgcaaaataaccgtgctaggggc

SEQ ID NO: 44634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggggcaacatcggagggcctggtgggg

SEQ ID NO: 44635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggggtccctaaaccttacagcagtatg

SEQ ID NO: 44636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgggtacaataactatatcgcggcttta

SEQ ID NO: 44637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgggtgggggctacaatggcgttgtatc

SEQ ID NO: 44638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggtaacttcacacatgtgtacttcgcc

SEQ ID NO: 44639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggtacgacgattgatcgtggcattcca

SEQ ID NO: 44640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggtcacgggtcagatccggtattcacg

SEQ ID NO: 44641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggtggtacagatgttatcttcaccctt

SEQ ID NO: 44642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggttaaacaaaatgccaactgcttcgg

SEQ ID NO: 44643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccggttagggattccacgggaggctacgg

SEQ ID NO: 44644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtactctgccagtcgtactgacaccta

SEQ ID NO: 44645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtcagtcagttttcaataggtctgttg

SEQ ID NO: 44646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtcatcactttcttccgcgttatgtga

SEQ ID NO: 44647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtgtcgggtggcggggttttggccggg

SEQ ID NO: 44648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtgtgaaacgcccgagcatgcagtgca

SEQ ID NO: 44649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtgtgtcaagctctcgcagtgagcacg

SEQ ID NO: 44650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtgttgctaacatgtttccttgctatg

SEQ ID NO: 44651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgttcgtcccgggaaaggcaatgacggg

SEQ ID NO: 44652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtttggtactggaattcgtgccccacg

SEQ ID NO: 44653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtttgtagtgaaagatccgattcgagg

SEQ ID NO: 44654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccgtttttaaacctctcagggcgagatcg

SEQ ID NO: 44655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctaaccacacaaaacaggtatgaagatt

SEQ ID NO: 44656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctaccttcaacttaggtttacctcacgg

SEQ ID NO: 44657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctaggcaacgactcgtgcgacgcttgtt

SEQ ID NO: 44658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctagttgctgaatcgggccgaccgaagg

SEQ ID NO: 44659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctatacttctctcgtctcccgatcaggt

SEQ ID NO: 44660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctatcgtgcacgttcacacgcgtaagag

SEQ ID NO: 44661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctatgcttttccgtgaattctgttcgag

SEQ ID NO: 44662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctcaaggggaccggctcgcctcacgctg

SEQ ID NO: 44663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctcacagtactcaatatgtcgaagtggg

SEQ ID NO: 44664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctcccgcatgagatgagccatcatagtg

SEQ ID NO: 44665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctcccgggtactgggactttcaaggtga

SEQ ID NO: 44666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctcgtcgaacacggggggcgtggtcttt

SEQ ID NO: 44667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctcgttacactattgatgtgtgattggt

SEQ ID NO: 44668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgacactccttacttcctttgtgcaac

SEQ ID NO: 44669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgatgcatgcacctgttcgaaacccat

SEQ ID NO: 44670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgattaaagaatccagaaggtacaggt

SEQ ID NO: 44671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgcacgtatcggtgattggttcgtggg

SEQ ID NO: 44672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgcagttacaatgaccctggtggggac

SEQ ID NO: 44673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgcttcacgagtttacggacctgcccc

SEQ ID NO: 44674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctggatggagacgtaacttacctcgtac

SEQ ID NO: 44675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgggtgaatgtcaaacgagcggggcca

SEQ ID NO: 44676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgtcgttccatggtgaatgtttcgttc

SEQ ID NO: 44677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgtggttaggcggaaggagcaattcct

SEQ ID NO: 44678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgttcactactctcgacacggttctgg

SEQ ID NO: 44679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctgttcacttcacgtgtagataagacga

SEQ ID NO: 44680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccttaccgaacttcgcgctggctactggt

SEQ ID NO: 44681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccttactccaaccgtgtcctagttgctgt

SEQ ID NO: 44682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccttcgagctccgtggctgcggttgcaca

SEQ ID NO: 44683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccttgaaggtaggattcacgaaggtcaag

SEQ ID NO: 44684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctttaatgtaccagagttccgttttagt

SEQ ID NO: 44685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcctttgcattagcgatgagttgccacgtt

SEQ ID NO: 44686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgccttttctagtgcagaagggttggacatg

SEQ ID NO: 44687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaaaccgatagagcccacgctggcatgt

SEQ ID NO: 44688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaaatgtgccacgatatactccaagtca

SEQ ID NO: 44689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaaattgagttggatgtattgggcggtg

SEQ ID NO: 44690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaacaaaagattgctgatcgtctgccgc

SEQ ID NO: 44691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaacactcatcacatcggaattagcgta

SEQ ID NO: 44692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaactagtgcacgtgccataggtccgat

SEQ ID NO: 44693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaaggtccggaattccgtgcggtcatac

SEQ ID NO: 44694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaagtcccatagcactttaaagaagagt

SEQ ID NO: 44695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaagtctggttgatccggtcgggtttcg

SEQ ID NO: 44696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaagttgtgatggttagcattagggttc

SEQ ID NO: 44697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacaatgctgctacagtgcctcgtgaag

SEQ ID NO: 44698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacagaacgtgttattgccatcctgatg

SEQ ID NO: 44699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacaggggtgtggtacatctcccggctc

SEQ ID NO: 44700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaccattgacgctttttcgctgccagac

SEQ ID NO: 44701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaccccaaccctggctttgggatggtcg

SEQ ID NO: 44702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaccggggcttaagtaggatggagcggg

SEQ ID NO: 44703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacctaatatcactccacgtgtgtgtgg

SEQ ID NO: 44704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacctgaacgagacgaggtcgacatgtg

SEQ ID NO: 44705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacgagagaagtctagagcggcaccagg

SEQ ID NO: 44706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacgaggtaataagaccggactgtgggg

SEQ ID NO: 44707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgacgtacattgccccggtgtgcatggct

SEQ ID NO: 44708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgactcgtttcacgggcgttgttgtgtgc

SEQ ID NO: 44709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgactgagtagacgtcagcacgaaatcga

SEQ ID NO: 44710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgactgtaccgtcaaggtggctatcctgt

SEQ ID NO: 44711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgactgtcatacatttactggctgggctt

SEQ ID NO: 44712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgactgttgcagtgaatttgccaagtggg

SEQ ID NO: 44713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagaacagagctgggcgagttgggcggt

SEQ ID NO: 44714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagaggtgtatggaattcggtgactgct

SEQ ID NO: 44715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagagtgcgtcagacagtggctttgagc

SEQ ID NO: 44716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagattcgtggttcgatgtttgagtccg

SEQ ID NO: 44717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagattgatggtgcatgttgcccgagat

SEQ ID NO: 44718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaggagctattgccggtgtccctaggcg

SEQ ID NO: 44719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaggggtggaactcatctgtcgcctcca

SEQ ID NO: 44720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagggtgtttgaagaatgacataaaccg

SEQ ID NO: 44721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaggtccaacatcgtcttggttccgatt

SEQ ID NO: 44722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgaggtgctgatttcccggggtgacagtg

SEQ ID NO: 44723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagtataggtaagattgtttgttcttat

SEQ ID NO: 44724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgagtctagcgaacttacggttgcctact

SEQ ID NO: 44725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgataagcattggggttccgttcgtcagg

SEQ ID NO: 44726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgataccggtcacccttcggtgccgtccg

SEQ ID NO: 44727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatacgtacgctgttacgcactagtctt

SEQ ID NO: 44728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatagagacgctgtttaacgccaatgca

SEQ ID NO: 44729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatcgaagtatgcctttacaactcctgg

SEQ ID NO: 44730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatcttgcaacgattgaaatgctcggga

SEQ ID NO: 44731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatgacattgtgttgccttttcccgggc

SEQ ID NO: 44732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatgcggatatcgtcttcttgttcgttc

SEQ ID NO: 44733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatgtagctgggaagactgtttgaagct

SEQ ID NO: 44734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgatgttcgtacgctgagttagatgtcac

SEQ ID NO: 44735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcaaatacgttgatccctgcccgcagcg

SEQ ID NO: 44736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcaacaattgatccccgtttcatgggcg

SEQ ID NO: 44737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcaacggatgggaaggcattggcacggc

SEQ ID NO: 44738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcaagtccgctgccagtcttgtgtggaa

SEQ ID NO: 44739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcaatttgtcagcttactttctttcctc

SEQ ID NO: 44740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcacagcatggcagagtaggctgaaggg

SEQ ID NO: 44741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcacatactacccgggaagcggcatggc

SEQ ID NO: 44742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcacgagtactccgcaaacgtggcagac

SEQ ID NO: 44743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcactttcctcatttaatcctcttgagc

SEQ ID NO: 44744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcagactgtgctaacgccaaaccggcta

SEQ ID NO: 44745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcagcacacgttcctatgtctcaattac

SEQ ID NO: 44746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcagggtaggctaggtatgtgagggggt

SEQ ID NO: 44747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcagtcagtctgataacgcgcgaagtcg

SEQ ID NO: 44748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcagtcggttgaacagagtgtacattcc

SEQ ID NO: 44749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcataaatgcacattcagaggtccctgg

SEQ ID NO: 44750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcatccattagtatcacgcttttctttc

SEQ ID NO: 44751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcatcggggagccgaatctgtcttcaca

SEQ ID NO: 44752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcatgcgcaaataccccgggtcggtcga

SEQ ID NO: 44753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcatggggattacgatcttctgtttttg

SEQ ID NO: 44754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcattacggcctcttgtgtgggatctcc

SEQ ID NO: 44755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcatttgtggccgcacgtgccgatggag

SEQ ID NO: 44756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgccaagttatgtgttccgacgtaccggc

SEQ ID NO: 44757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgccactacgtttgggtctcggacggccg

SEQ ID NO: 44758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgccagcggatgatctacgtgcccctagc

SEQ ID NO: 44759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgccagctagcggggttggtccactctgc

SEQ ID NO: 44760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgccatacgggaaaacacggagtaagttc

SEQ ID NO: 44761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgccggggcaagtgtggtccggatctgga

SEQ ID NO: 44762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcctaatgccgacacttgtattagaggg

SEQ ID NO: 44763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcctgacatcaggtattatcctatgtgg

SEQ ID NO: 44764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcctgccattcgtgtgcaccattagcgc

SEQ ID NO: 44765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcctgttccgagcgggaaaggttacgcg

SEQ ID NO: 44766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgaccggaccgagatgtagcaaggggg

SEQ ID NO: 44767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgacggctgagtggatgtcgggaagtg

SEQ ID NO: 44768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgaggccgaattagtccgcgattggtt

SEQ ID NO: 44769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgcagtaccgctctaccgtcgcaatcg

SEQ ID NO: 44770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgccatcgggtttaaagcaagcggctg

SEQ ID NO: 44771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgcgtaccggcgtgtaatcccgttcgt

SEQ ID NO: 44772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcggactgatgttaattagtggccctgg

SEQ ID NO: 44773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcggatcatggtagacgatcgctatttc

SEQ ID NO: 44774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcggtgagtcttaagcaaatggccttac

SEQ ID NO: 44775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgtaaaggatcacctcttcggggccgt

SEQ ID NO: 44776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgtatgttagcgtactcagggcaccgg

SEQ ID NO: 44777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgtcactcttcagccttttccgataca

SEQ ID NO: 44778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgtgcggctgtaataaactgatcagtc

SEQ ID NO: 44779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgtggatggtaaagccaagtctcatta

SEQ ID NO: 44780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgttaaccacgtgtgtttctatccatt

SEQ ID NO: 44781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcgttaattctgggtcccccgtgtcgta

SEQ ID NO: 44782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgctacgagatagggtagagccgttagtc

SEQ ID NO: 44783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgctacggaaaccatttctaggcgtgaac

SEQ ID NO: 44784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgctgacatctccaccccccttgactgct

SEQ ID NO: 44785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgctggagtcggttccaacagctgggagc

SEQ ID NO: 44786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgctggggcaagtgctctggtgatcaggc

SEQ ID NO: 44787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcttaggtacgcatgcgtccaagatgtt

SEQ ID NO: 44788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcttgcgtaccacctttccctgctctgg

SEQ ID NO: 44789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgcttttcctgaagccggaatcgttttcg

SEQ ID NO: 44790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggaagactagcggatctcctttcagtga

SEQ ID NO: 44791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggacaaagttcgccggcattgctcgttc

SEQ ID NO: 44792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggacactttacgttttaaccccgctcgt

SEQ ID NO: 44793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggacgcaagtcaaggtgatcgggtatca

SEQ ID NO: 44794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggagacaggttttcgggatcgttgctga

SEQ ID NO: 44795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggagggctctccggtaggatacggttct

SEQ ID NO: 44796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggataataatataacttcccgtttgatt

SEQ ID NO: 44797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggataggcccgggctaatcggcatcaaa

SEQ ID NO: 44798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggatcatattgactgtgctaaaggcttg

SEQ ID NO: 44799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggatcggggaaggcggctagtgtcggcg

SEQ ID NO: 44800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggattgggcctcgaaatagttacacggt

SEQ ID NO: 44801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggatttgggagagtatcccgctttatat

SEQ ID NO: 44802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcaaacaggtggttccggcccgcaggg

SEQ ID NO: 44803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcaaagtacgtctttgaagatgcacgt

SEQ ID NO: 44804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcaacggctaacacttgtctttattaa

SEQ ID NO: 44805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcaagcagacccacacgatacattagt

SEQ ID NO: 44806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcaatagcggtgtgggacttagggctg

SEQ ID NO: 44807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcaggctaggtctccaggccaaacccc

SEQ ID NO: 44808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcatggtattagtgttaaggtttgggg

SEQ ID NO: 44809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcattgtatgcgcataagcattatgtc

SEQ ID NO: 44810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggccctggcatgtttcgtactcttcggg

SEQ ID NO: 44811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggccggtgcttatcgttagtcgccgtgg

SEQ ID NO: 44812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggccgtacgcaactcctggtatcggtag

SEQ ID NO: 44813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcctccgatgttcgagctccccacgcc

SEQ ID NO: 44814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcctgtagaaacgaaattcgaatcgta

SEQ ID NO: 44815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggccttcggaccaaacactacgacatac

SEQ ID NO: 44816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcgatcacaccccaggctcacctgttt

SEQ ID NO: 44817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcgcataaccatgatcaggacctcggg

SEQ ID NO: 44818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcgccgaggatatatctcacaaatgtt

SEQ ID NO: 44819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcgcggtatcttgcggtgatagatctc

SEQ ID NO: 44820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcggcggtcagggttaggatgtggctc

SEQ ID NO: 44821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcgggggacaacgatttatacgcgtct

SEQ ID NO: 44822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcggtctgcccgtaaccaatatggggc

SEQ ID NO: 44823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggctcgtgctggttggagtttcgtaagc

SEQ ID NO: 44824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggctggatgcacctcacgggatggcgcg

SEQ ID NO: 44825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggctgggacggtgccgtcatcacggagg

SEQ ID NO: 44826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggctgggtctagaggagccgttgcaggg

SEQ ID NO: 44827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcttggagtcatgtgcgtcccagaacg

SEQ ID NO: 44828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcttgggtcgaccaagaatggcgctgt

SEQ ID NO: 44829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggcttgtatcgatacgctcaggtaacgt

SEQ ID NO: 44830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggctttgatgacctcccctgcaccagcg

SEQ ID NO: 44831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggaggcaactcgtataagcctggggcc

SEQ ID NO: 44832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggatggtatgggcctgttggctagcga

SEQ ID NO: 44833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggatggtgtggtcctgtacaactggac

SEQ ID NO: 44834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggcagtccgcgagatctcggtcaggta

SEQ ID NO: 44835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggcatgtagtgtttcattccgtcctgc

SEQ ID NO: 44836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggcccagcgaagggcgcaacgtgttcg

SEQ ID NO: 44837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggcgatgagcgaagctaaccagggcca

SEQ ID NO: 44838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggggacgttctcccacttttgcgagcgt

SEQ ID NO: 44839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggggagcagggtatgcgccacgggtcat

SEQ ID NO: 44840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggggttgaggtcgttgatgatttgtcc

SEQ ID NO: 44841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggggtctcggtatgctgttttttcggcc

SEQ ID NO: 44842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggggttcgtccgttgatgtacgggaatg

SEQ ID NO: 44843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggtcaacgtggaacggtacagcgcatg

SEQ ID NO: 44844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggtcctcgtgccagcagggccgtaggg

SEQ ID NO: 44845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggtcgaaccgtttgagggactcgcctc

SEQ ID NO: 44846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggtcggaagtggttcgcagttgcgagg

SEQ ID NO: 44847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggtctctaccatcccgttcaacttggg

SEQ ID NO: 44848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggtgtgagaaggtgtttgagatcgggc

SEQ ID NO: 44849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgggttgatttacctgcttcggttttacg

SEQ ID NO: 44850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtaaaccggattatgaagtggctgctg

SEQ ID NO: 44851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtacaatgacaagccaacatgtgtcgg

SEQ ID NO: 44852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtcaggggggggacgaagccagctgtg

SEQ ID NO: 44853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtccggtaaaggacgtcacaccatgta

SEQ ID NO: 44854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtcctaccagtcgttgggatccttctg

SEQ ID NO: 44855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtcttcgagggtgcccggttcggccgt

SEQ ID NO: 44856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtgcaagcctatgtaccacggggcagg

SEQ ID NO: 44857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtgcactaatctggcatgttgactgat

SEQ ID NO: 44858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtggcagtgacacggcagtactgaccg

SEQ ID NO: 44859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtggctggctataactttaagcggtaa

SEQ ID NO: 44860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtgtctgaagcgtacaggatagaggca

SEQ ID NO: 44861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtgtgaaatccatagattatgcgttcc

SEQ ID NO: 44862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtgtgccggtggtatcgttgttgaggt

SEQ ID NO: 44863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtgttggggttttcgcggtcaggtacc

SEQ ID NO: 44864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggttcaggtagtttcgttaggtattgta

SEQ ID NO: 44865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggttcggggaaaggccagctggtttttt

SEQ ID NO: 44866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggttcttgtacattggaccagtatcttc

SEQ ID NO: 44867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggttgtataagccaagtccccccgggta

SEQ ID NO: 44868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcggtttggatccggggtcaattaattaag

SEQ ID NO: 44869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtaatgtgcggtggcgggagcgtcggtt

SEQ ID NO: 44870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtaattttaccttcgttcgacaaattgt

SEQ ID NO: 44871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtacaaaacgcagatagacgacctcgca

SEQ ID NO: 44872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtacaagctatcgatgtcactggcccac

SEQ ID NO: 44873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtacggttatcattagggtgggtttgca

SEQ ID NO: 44874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtatgaactgctcgacgcgtgctttaag

SEQ ID NO: 44875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtcacggaagtggttggttgtgaacaca

SEQ ID NO: 44876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtcatctacggatgtgactgttcaacct

SEQ ID NO: 44877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtccgattggctttgtgtcgccggtgag

SEQ ID NO: 44878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtccgccgggtccatcctcgatcgcggg

SEQ ID NO: 44879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtccttccgtgggcaattgctggcattg

SEQ ID NO: 44880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtcgccttggcgcacacccagtcacctc

SEQ ID NO: 44881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctacccttagccgaccgttattggtg

SEQ ID NO: 44882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctccggaacagcctacacaaagggtt

SEQ ID NO: 44883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctcgtccgggggagctaatatcgacg

SEQ ID NO: 44884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctgactaaaaacggtacgaagaacct

SEQ ID NO: 44885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctgataagttgcgaagtggaagttgc

SEQ ID NO: 44886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctgggagattctgcattcatgcgtgt

SEQ ID NO: 44887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtctgtaccgtcatcgaatgcctcgctt

SEQ ID NO: 44888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgaacgaaaggacaggtgaactggcaa

SEQ ID NO: 44889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgacttacaaggccgttgccacgtgcg

SEQ ID NO: 44890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgatcgcatcgcaagccttcgccgggt

SEQ ID NO: 44891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgccaaaagctgcattagggcgcgaac

SEQ ID NO: 44892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgccttaaagccgaacgagttccccta

SEQ ID NO: 44893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgccttggggcaaatgcatccgtacat

SEQ ID NO: 44894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgtattttaatcgcctgggtcgtcaga

SEQ ID NO: 44895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgtcaagcccgggaatagacgcggcgg

SEQ ID NO: 44896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtgtcatggcgaatagcgccatagtgcg

SEQ ID NO: 44897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttaaatcgcctcacctgtaaacagctt

SEQ ID NO: 44898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttaaccgaggagccccagtttgtgctc

SEQ ID NO: 44899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttatatgaaacaatctgttgtgaatta

SEQ ID NO: 44900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttgattggacgatttcatcgatggagt

SEQ ID NO: 44901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttgcccacagctgttagacgagagccg

SEQ ID NO: 44902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttggatcatcggtgcattattcactcc

SEQ ID NO: 44903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttggcgttcctggggacatgtgtggtc

SEQ ID NO: 44904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttgtgaatcaacggatttgcgatgctt

SEQ ID NO: 44905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgttgttcttaaagacattcatcacgagc

SEQ ID NO: 44906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcgtttaattcttggcggcgccgttcattc

SEQ ID NO: 44907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaaagttcgtaggtcatgccgatttgtg

SEQ ID NO: 44908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaacaaaagctagtagcacgcattgcca

SEQ ID NO: 44909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaacgaagtgttcttagcgtacggggac

SEQ ID NO: 44910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaacggggggtcgtcacacggcgggttc

SEQ ID NO: 44911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaacgttgggccaagcgcgactgccggt

SEQ ID NO: 44912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaactccccagttcacaagtccgcacac

SEQ ID NO: 44913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaaggtgggcgttatcatggggtgtgct

SEQ ID NO: 44914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaataccggggatggttcggcatgccgg

SEQ ID NO: 44915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacaagggctgtacgcgtgtggggttta

SEQ ID NO: 44916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacaccgacgtttaactcgcagcacata

SEQ ID NO: 44917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacccacacttccgacaatgttaccacg

SEQ ID NO: 44918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaccgaggagatttgcttaactcgagtt

SEQ ID NO: 44919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacctcggccatgcgggactcaggactt

SEQ ID NO: 44920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaccttacaaggtccagctaggaatggg

SEQ ID NO: 44921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacgggtcaggcggctttctctcgtttg

SEQ ID NO: 44922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacgtacgacacccatacccatagtccg

SEQ ID NO: 44923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctacgttcgatgagggtggacttcgttat

SEQ ID NO: 44924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctactcatgcgttttcctaacctgggctc

SEQ ID NO: 44925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctagaccattcgattgggagaatggccag

SEQ ID NO: 44926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctagcggtcccctctgcagatcggtcttt

SEQ ID NO: 44927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctagctgacccacctcgatctgcgcgggg

SEQ ID NO: 44928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaggactgaaaccaatgtgcagtggtcc

SEQ ID NO: 44929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaggagaagaccttggttttggtcgctc

SEQ ID NO: 44930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctagggcctgcaattttttagtggggggc

SEQ ID NO: 44931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctaggtagtccgtgtttgtggtcgcggta

SEQ ID NO: 44932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctagtttcctcgttgggcagagcgtgggg

SEQ ID NO: 44933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctatatcgccgttaactgttcgggaccga

SEQ ID NO: 44934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctatcgttgagcaacggagagctattgtg

SEQ ID NO: 44935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctatgggtccaatcccacagactcgtctc

SEQ ID NO: 44936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctattccttatcggcccatccgtaatcgt

SEQ ID NO: 44937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctattgccggtgtgctatcgtaaagcacg

SEQ ID NO: 44938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcaaccttaggctacggactttcccgcg

SEQ ID NO: 44939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcacctggccagttttccctgctctccc

SEQ ID NO: 44940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcacgagcaatggggtgttctccggtga

SEQ ID NO: 44941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcacgattacaactagcccatgtggctt

SEQ ID NO: 44942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcacggttgatcggaagaaaaggctaga

SEQ ID NO: 44943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcaggatcgtcctttacatctctcaatg

SEQ ID NO: 44944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcaggcaagtctaacagcacaggctgcg

SEQ ID NO: 44945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcaggcccagcgaacccgattcacaact

SEQ ID NO: 44946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcatgatctctcctagccgccaattcac

SEQ ID NO: 44947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcatggtagtatgtcattgcacacgttg

SEQ ID NO: 44948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcatttcttgactttcgtcttcctgtgt

SEQ ID NO: 44949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctccatagactttctatttatgtgtcatg

SEQ ID NO: 44950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctccccagatgttacgcacctggactctg

SEQ ID NO: 44951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcccgctctattatatgttggcgttccg

SEQ ID NO: 44952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctccggtaagtggtgtttgctcgcgtcca

SEQ ID NO: 44953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctccttgggtattggtctggttccttatt

SEQ ID NO: 44954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcctttttctcgggtcacgcaggacagg

SEQ ID NO: 44955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgaaacggctgacctcgaaaggctcgg

SEQ ID NO: 44956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgatcgggcggacgtggggttatccgg

SEQ ID NO: 44957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgattccacgcagtcgtagatctaccg

SEQ ID NO: 44958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgcgggcatgggaagacgacttactcg

SEQ ID NO: 44959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgctgtcattacaacctcaggatacga

SEQ ID NO: 44960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgtacggatttatcatgaggaaccgaa

SEQ ID NO: 44961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgtcttagtgtgggcccaatccgctca

SEQ ID NO: 44962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgtgttttgcggaccagtattagccca

SEQ ID NO: 44963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcgttgaaagtgatcccgttaggcttcg

SEQ ID NO: 44964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctaggaagaccaagccgatgaggtggg

SEQ ID NO: 44965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctcagctgtttacgtcccgttcttccg

SEQ ID NO: 44966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctctcgtctcatatttgaacggtcctg

SEQ ID NO: 44967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctggggacccgtcgatggttggtaatc

SEQ ID NO: 44968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctgtaacccaccccctatcggtaaacg

SEQ ID NO: 44969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctgtaaccgtgacagccctcgcacctc

SEQ ID NO: 44970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctgttacgtgggtacaataatttgtgc

SEQ ID NO: 44971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctcttggtgctttactccggtataggttt

SEQ ID NO: 44972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctctttgagaggtgttctttggcgggcca

SEQ ID NO: 44973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgaaacctgagcgtcacccgtctggggg

SEQ ID NO: 44974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgaaggggactcgggacatccacggcaa

SEQ ID NO: 44975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgacaaagggagtaagatataagccgcc

SEQ ID NO: 44976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgacctcaacaccccttcggatggtatc

SEQ ID NO: 44977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgactggttggtctgatgtgacaccaat

SEQ ID NO: 44978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgagccagtacagccacttgttgctcgt

SEQ ID NO: 44979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgaggagggtgatatctgccatttgcac

SEQ ID NO: 44980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgaggctcgagttcgttcgccgtactcc

SEQ ID NO: 44981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgatgaggctccgtgcacgctggaatgt

SEQ ID NO: 44982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgcactctggttcaatgttttctgaata

SEQ ID NO: 44983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgccaaatgccatacggtaagcgcgagg

SEQ ID NO: 44984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgccatgggttaattatgggacattgca

SEQ ID NO: 44985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgcgtctcgatctattcccggtagtgct

SEQ ID NO: 44986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgcgttctgtatggctttaccggcttgg

SEQ ID NO: 44987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgctcgtctcaccttggcacattctccg

SEQ ID NO: 44988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggaacctcacgattaggcacgtacctt

SEQ ID NO: 44989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggcacacttcacgggatagtaccggat

SEQ ID NO: 44990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggctactacggtaccattactccgagt

SEQ ID NO: 44991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgggtcggctactatctgtcgattagcg

SEQ ID NO: 44992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggtccggtctctcgctggctttgttga

SEQ ID NO: 44993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggtcgtaggaaacagatgacttttgcg

SEQ ID NO: 44994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggttatgcgcacggtgtttttggtgtt

SEQ ID NO: 44995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctggttcacggtggtgagatttggtgtcg

SEQ ID NO: 44996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtacgggctagtaccgggggcggcgct

SEQ ID NO: 44997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtactttattcgtctcataactggtgg

SEQ ID NO: 44998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtagagtgtgaacgctccatggtgcgt

SEQ ID NO: 44999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtatgtacgttgcgacggctggcaagg

SEQ ID NO: 45000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtcccgagattagtaagacacgagaaa

SEQ ID NO: 45001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtccggaggtctccgatttgatgcctt

SEQ ID NO: 45002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtcgcgtgtccgtcgctcttgtagtac

SEQ ID NO: 45003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtgaatgctacgttgggggggcgtact

SEQ ID NO: 45004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtgatgggactgcggagcctgccgcgc

SEQ ID NO: 45005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtgcagacgtgtaatgtgaaattctcc

SEQ ID NO: 45006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtgcatttactctccatacagattgca

SEQ ID NO: 45007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgtgccccgagcctggttacggtcgcca

SEQ ID NO: 45008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctgttgcaattggatgggacgaaatggcc

SEQ ID NO: 45009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttaatattagttcggtgggcttgggtta

SEQ ID NO: 45010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttacggtctcacgtatcagcaatgaggt

SEQ ID NO: 45011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttactcgctacaggatctcgaattgcgg

SEQ ID NO: 45012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttactgctatattgtatagatctcggtc

SEQ ID NO: 45013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttagtgactgaatgatcggtgtctacgt

SEQ ID NO: 45014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttatttcgatggccaggggggttctact

SEQ ID NO: 45015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcaatcgacctatgacaccgctctcgt

SEQ ID NO: 45016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcacgtcgcggcgatgatgtctaaggt

SEQ ID NO: 45017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcagatcagccagcattgtgggccgcg

SEQ ID NO: 45018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcaggtgcgtgggcgtggggctcgtgg

SEQ ID NO: 45019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcatctatcgtttccactaatggttgt

SEQ ID NO: 45020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcccagatggtgatcaacagtgcatgc

SEQ ID NO: 45021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcgaaacttcagtgtagaccaacacgt

SEQ ID NO: 45022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcgcagctttggtcccccgagttgcac

SEQ ID NO: 45023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttcgtggcgtcagttaattctgcgggcg

SEQ ID NO: 45024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttctaatagagctgtttgtcacggagtc

SEQ ID NO: 45025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttctgcaggagggctgccgttttgtcgc

SEQ ID NO: 45026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttctgtctgcgaggtatccagtgctggt

SEQ ID NO: 45027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttgaaccgttcacgagggatgccatgcg

SEQ ID NO: 45028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttgaggacggttgacacgcgtaggcaga

SEQ ID NO: 45029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttggacgagacactagcgttcgtatggc

SEQ ID NO: 45030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttggatcagatttgggtctcagatcgtt

SEQ ID NO: 45031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttggtgtcggaacgggtgttgctccggt

SEQ ID NO: 45032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttgttggcgagtctccgtgcgtggatca

SEQ ID NO: 45033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctttatgtgtagagatctggtagttcggg

SEQ ID NO: 45034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctttgaggagatcatttttacactgggcg

SEQ ID NO: 45035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgctttgggtgaggtgatcgtacatcctcga

SEQ ID NO: 45036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttttaacgtcaggattggactttcgttt

SEQ ID NO: 45037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttttgatattaccgggccgttcctaaat

SEQ ID NO: 45038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgcttttgtgcagtaaagtgcatgtagcgtt

SEQ ID NO: 45039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaaagcgtcaatacgggtcgtcgttctg

SEQ ID NO: 45040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaagagtcggttcagtccctagatgagg

SEQ ID NO: 45041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaagggtgtagggggccaaatctcgtga

SEQ ID NO: 45042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaagtctgtaaatcacccttcgcggcct

SEQ ID NO: 45043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacaatttaacatcgggcgcaacaatca

SEQ ID NO: 45044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacacagcgcgataagtcggaaaatgct

SEQ ID NO: 45045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaccagacacggtggcggattcacccgt

SEQ ID NO: 45046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacccagcagtcacgattcctggccccg

SEQ ID NO: 45047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacgagtaaagacaatgcacctgttgcg

SEQ ID NO: 45048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacgggcgtgtagttagggattttcgaa

SEQ ID NO: 45049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacggggaccgagtagggcggcgtaggt

SEQ ID NO: 45050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacgtaatcggagttagggttggaggtg

SEQ ID NO: 45051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaacttggttgctgtggttcgtgtttcgt

SEQ ID NO: 45052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaagactgctcaatgaccgtgttaagcac

SEQ ID NO: 45053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaggcgaagggcgggaacgtcgagttac

SEQ ID NO: 45054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaggctaatgcaaggtagaaacggatgt

SEQ ID NO: 45055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaaggctgttgtggcttttcatgagcggg

SEQ ID NO: 45056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatacctttggaatgaggtgttgtgcca

SEQ ID NO: 45057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatactagttgtcaggctcgctgattac

SEQ ID NO: 45058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatagacgaccatctcatcgaagtgttg

SEQ ID NO: 45059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatagagcctaccaacgattttccgggt

SEQ ID NO: 45060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatagtttattggtttcgtcagggcata

SEQ ID NO: 45061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatcgtgagatttgcctaggctttccga

SEQ ID NO: 45062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatgccagcgaggtccttcacgatatcg

SEQ ID NO: 45063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaatggtagctaacagacagttgtttgtc

SEQ ID NO: 45064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaattaaagtgcggccattatggtttatc

SEQ ID NO: 45065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaattaacatacagatggtagtttgtgtt

SEQ ID NO: 45066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaacgaggctcaccgagtggtaatcca

SEQ ID NO: 45067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaacgtctacaacatcctgtcgggcgg

SEQ ID NO: 45068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaagaaggacagtccacacagtctgac

SEQ ID NO: 45069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaattccgagagcgtccttgccacgtt

SEQ ID NO: 45070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacacacgttatcctcacccgatcatctc

SEQ ID NO: 45071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaccgtgagcgcatctcgtctttggcg

SEQ ID NO: 45072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacacggatatacttttccctgtgacgtg

SEQ ID NO: 45073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacacgtggcgacattggcttatcctgct

SEQ ID NO: 45074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacacttcacacgcatgggcagctctgcg

SEQ ID NO: 45075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaggaacggatgtacctgggcagggag

SEQ ID NO: 45076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacaggggagatgcgggttctttgacaag

SEQ ID NO: 45077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacagtgctgcttggccttgctggccctt

SEQ ID NO: 45078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacatcaccccctaatgtcgcggcggaac

SEQ ID NO: 45079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaccaacggagacgtgtgcttcgggttgt

SEQ ID NO: 45080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaccaactttttgcggcgtgatacgaacg

SEQ ID NO: 45081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaccgacgggaatcgaacgataagtagaa

SEQ ID NO: 45082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaccggggccgaacgtgtatgaggcaggc

SEQ ID NO: 45083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaccttcccgctcttttccaatgcgctgc

SEQ ID NO: 45084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgagtccagggtagttccacgcctcct

SEQ ID NO: 45085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgcctcgtcaaggagcgttcactacgg

SEQ ID NO: 45086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgcctgccaaacttaccccgattgttg

SEQ ID NO: 45087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacggaaattagtgatcatcgaccatggg

SEQ ID NO: 45088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacggagaacgagggttcctccatcggct

SEQ ID NO: 45089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacggttttgaatcaataggcctcgggcg

SEQ ID NO: 45090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgtaaacctccgatattgatactcggc

SEQ ID NO: 45091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgtcaggaggcaccaactagattacgt

SEQ ID NO: 45092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgtccgggtacgacacccacgaacgga

SEQ ID NO: 45093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgtgtagtaggtggttggttgacgtgc

SEQ ID NO: 45094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggacgttacatacgggcagggtaccgccac

SEQ ID NO: 45095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactaagatggggcaacgatgggcgctca

SEQ ID NO: 45096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactacgactgaatcgaaatgagaacccg

SEQ ID NO: 45097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactagcatctccgctgttgcaggttaga

SEQ ID NO: 45098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactatcacccgggagcttatacattgtc

SEQ ID NO: 45099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactcgagtagtgcctgctgcttagtgtc

SEQ ID NO: 45100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactcgcaggttctttggctcacaggggg

SEQ ID NO: 45101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactcggtgttcaaaaggatttcattgtc

SEQ ID NO: 45102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactctgcgtcacggagaagcttttggaa

SEQ ID NO: 45103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactctgtgaacatcgatcgctacgtgtt

SEQ ID NO: 45104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggactgtccgcgtatgttccagttacacgc

SEQ ID NO: 45105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagaaattgacccgtttccgactccctgc

SEQ ID NO: 45106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagaaggttagaagagggtgttcgggcgt

SEQ ID NO: 45107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagaagtatgaaagtagttgaagggttgt

SEQ ID NO: 45108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagaattcaaaagcggccgcgttgggttg

SEQ ID NO: 45109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagacactcacatcacggtagcgcctaat

SEQ ID NO: 45110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagacgtgcctgatccggatgtcttcaga

SEQ ID NO: 45111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagactcgtaaatgcgatactcatagtcg

SEQ ID NO: 45112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagaggcgcgtcggcagggtcagagccgt

SEQ ID NO: 45113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagcaaaccaaggagttcatgctttcttt

SEQ ID NO: 45114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagcaagcagcgttgccggggataacctt

SEQ ID NO: 45115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagcatagacgctcccaggggacaattta

SEQ ID NO: 45116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagcgggtatggctgccacaggggggtta

SEQ ID NO: 45117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagcgtctggaagaggattaaattaggcg

SEQ ID NO: 45118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagctatcgacatagggtgcttgtgtggt

SEQ ID NO: 45119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagctgtgtcttatgtgcttgtttatctt

SEQ ID NO: 45120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagcttactaatcgtcatggtattcgcag

SEQ ID NO: 45121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggaaacactaagttcgcgggccttatg

SEQ ID NO: 45122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggaatgcctcggaagatgcaatggttc

SEQ ID NO: 45123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggagcggatcaccactatctgggcatc

SEQ ID NO: 45124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggaggccctgtaagctgtggtggatcc

SEQ ID NO: 45125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggcccaacacctcgagcgctccatacc

SEQ ID NO: 45126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggcgtagttcgtcttatgcgcctggcc

SEQ ID NO: 45127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggcttagcaggaccctaaatgtcatcg

SEQ ID NO: 45128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagggatactttggacttaatcttttaga

SEQ ID NO: 45129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggggggatactttgcctggatgatcac

SEQ ID NO: 45130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggtcaacttggaaccgtgggggaggtg

SEQ ID NO: 45131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggtgctacggtgtggagccttgtgacc

SEQ ID NO: 45132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggttccatttacatgagtcaatagtga

SEQ ID NO: 45133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggaggttggtcgagataccggggtaaccaa

SEQ ID NO: 45134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtactgcaacattctgatcttcccatg

SEQ ID NO: 45135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtagcgctggtccaacccgtcgaaagg

SEQ ID NO: 45136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtaggttagcgctgtctcttcgccttc

SEQ ID NO: 45137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtcctgagctataatagcttgcgtatc

SEQ ID NO: 45138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtcctttccgttcgcggtggacaagaa

SEQ ID NO: 45139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtctcaattttgttgtcgggggagttg

SEQ ID NO: 45140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtggggctatcttaacgtgtctcatat

SEQ ID NO: 45141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagttatcggattatggctgtgacaacat

SEQ ID NO: 45142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggagtttgacatcaccagaagcctggggtg

SEQ ID NO: 45143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggataaaattctgtgagtgtcgatttaact

SEQ ID NO: 45144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggataccgcttccatttggtgactatacgg

SEQ ID NO: 45145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatactgacgactggcctttcgaaaccca

SEQ ID NO: 45146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatagatggggtgcggcgcgttctgcagc

SEQ ID NO: 45147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggataggatctgccctcctgcagcagggag

SEQ ID NO: 45148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcaagttatctgcttaactgtcgatcg

SEQ ID NO: 45149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcaccttgtctgcgcaatctgtgatcg

SEQ ID NO: 45150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcacggattcgcactggaatggaaaac

SEQ ID NO: 45151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcactcgctagggtccgtggtggtact

SEQ ID NO: 45152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcagctgacgctaaagcgcggatttct

SEQ ID NO: 45153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcagttccagtcttgccctgcccgtct

SEQ ID NO: 45154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcatcgtcaagaccatgagttagtgcc

SEQ ID NO: 45155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcccatcgtgccaaagctgggtgcgct

SEQ ID NO: 45156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatccgggcctggtgaaccaactttggac

SEQ ID NO: 45157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcgacggtaggcaagacgacacgtcat

SEQ ID NO: 45158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcggccttaggcttcactgagaacgga

SEQ ID NO: 45159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctagaattggttaatgtttactggac

SEQ ID NO: 45160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctagagcggacgacggcgcacgccca

SEQ ID NO: 45161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctcaaggctgatctgtgggctggctg

SEQ ID NO: 45162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctcacgcacattagccctctgccata

SEQ ID NO: 45163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctcgagcccagggccgggttgtttga

SEQ ID NO: 45164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctctacttgtgatcctcggggcccat

SEQ ID NO: 45165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatctggggagtacgccgttgagtattgg

SEQ ID NO: 45166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcttaaagtatgtcgtcgtaagatttg

SEQ ID NO: 45167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatcttagaggaaaagttacgttgtctcg

SEQ ID NO: 45168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgaacccggcagtcagcagcctgattg

SEQ ID NO: 45169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgagtgcaagcaccccaaaagaggccg

SEQ ID NO: 45170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgcagtccccgattggatcttcggctc

SEQ ID NO: 45171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgccaaaaactgcggatacaattggga

SEQ ID NO: 45172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatggcattactagttatctgcggactac

SEQ ID NO: 45173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatggcgttctggctactaacgctgttta

SEQ ID NO: 45174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgggactagcatagggagatgccaccc

SEQ ID NO: 45175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatggtgtgttctgttggtttcggggtac

SEQ ID NO: 45176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgtatatatggcacacggggttgtaac

SEQ ID NO: 45177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggatgtcggtgtatgttcgtcgccgcttga

SEQ ID NO: 45178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggattaatgcgaccataacccggtgcggcg

SEQ ID NO: 45179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggattatccccgtggttcattcagttctcc

SEQ ID NO: 45180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggattcttgcttagagattaatcttagtga

SEQ ID NO: 45181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggattgccgtacacgtacttattcactaac

SEQ ID NO: 45182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggattgtaagaatgagtacggttgagatga

SEQ ID NO: 45183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggattgttacacgttgttctcccgaggttt

SEQ ID NO: 45184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaaagggccacttgagatggactcggcg

SEQ ID NO: 45185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaacctaaaagttttccaaagttcgttg

SEQ ID NO: 45186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaacctaccatttcagttgtgtgctctg

SEQ ID NO: 45187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaactcgcggactttcttcgttatctgg

SEQ ID NO: 45188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaagagacggcggacgctcagttgttcg

SEQ ID NO: 45189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaaggcgttcagcgcgtaaggtttgtgg

SEQ ID NO: 45190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaaggctaatgtgaggagccaacgacca

SEQ ID NO: 45191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaatacctatcctgaattgggagtggag

SEQ ID NO: 45192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaatggtgctattttgggcttgcttgtg

SEQ ID NO: 45193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaatgtcacgtgtccagcggcgaggata

SEQ ID NO: 45194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaatttaacatcgtctggggcgaatgcg

SEQ ID NO: 45195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaatttaagactgtagcgaagggggccg

SEQ ID NO: 45196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaatttggtgtgagtgcagagtctttct

SEQ ID NO: 45197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacaaacttttcaaactagacctcctgg

SEQ ID NO: 45198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacaaggcggaccgcatgagacgactgg

SEQ ID NO: 45199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacaatgattgcgtgtgcggtacagttt

SEQ ID NO: 45200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacaccgtctgcgtcgcatcctggcgtc

SEQ ID NO: 45201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacacgataatctgacctcgcagcgggt

SEQ ID NO: 45202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacaggcgtggtggcattagtgcgctgc

SEQ ID NO: 45203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacagtcccttgatgtcactagctcgag

SEQ ID NO: 45204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacagtgtcaatggtttcacatgccgat

SEQ ID NO: 45205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacatgggtggcttcctcgagatcagga

SEQ ID NO: 45206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaccggaccattcaccgtcttccgggcc

SEQ ID NO: 45207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaccgggcttcaggaccaagggagacgg

SEQ ID NO: 45208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacctcaagtgaaattgtggaataatcc

SEQ ID NO: 45209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaccttaatacacgagctcgcataggcg

SEQ ID NO: 45210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaccttacacgcacaatcttgcagtcga

SEQ ID NO: 45211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgagtttgagaacgggttctgcactc

SEQ ID NO: 45212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgatcagccctgggctactcgaaggg

SEQ ID NO: 45213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgatcgactgaggttatacggcaatg

SEQ ID NO: 45214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgcgtcagttggtgattcgtttctgc

SEQ ID NO: 45215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgctacgttttatccggcctgagcga

SEQ ID NO: 45216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacggagcgacgacgaggatttgaggcg

SEQ ID NO: 45217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgtgccctactgcaattctgcgcccg

SEQ ID NO: 45218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcacgttatgctcgtttggttggagcggt

SEQ ID NO: 45219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcactaaagcgacgattatcccactatcg

SEQ ID NO: 45220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcactcgcatcctatcgttcctgccgtat

SEQ ID NO: 45221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcactgactgattgcagttgtgacgggca

SEQ ID NO: 45222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcactgttcaactcggatgcatacgctta

SEQ ID NO: 45223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagaaggctactcgtgggacttggttcc

SEQ ID NO: 45224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagaaggctccaaccaagcacaaattgc

SEQ ID NO: 45225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagagagagagggcatgatcccgttccg

SEQ ID NO: 45226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagagaggagccaatagatgcgcatggt

SEQ ID NO: 45227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagcagtcactaggcgcggcgtacgtaa

SEQ ID NO: 45228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagcgatcatttgttaatcgagtccact

SEQ ID NO: 45229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagcgccattaaatcttacacgtgtttg

SEQ ID NO: 45230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagctgtgttcacgaagcggtcgtggcg

SEQ ID NO: 45231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaggcttgcagagatgttatctcaactc

SEQ ID NO: 45232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaggtagctgatgtatcacgagtccgtg

SEQ ID NO: 45233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcaggtggagcagcgtatacaattctccc

SEQ ID NO: 45234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtcactcaatgcagcctgtgtgcggg

SEQ ID NO: 45235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtcaggcggggactacgttggccagg

SEQ ID NO: 45236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtccgcaagttgggagaccttttcgg

SEQ ID NO: 45237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtgagcggaaaccaaacataccacgc

SEQ ID NO: 45238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtgctattcttcggaggccaggtctc

SEQ ID NO: 45239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtggcttcctgacagtaccctcgtag

SEQ ID NO: 45240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagtgggacgaggcgagccacggggtaa

SEQ ID NO: 45241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcagttggcgaaccaaaatctggggaggt

SEQ ID NO: 45242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcataacacaccctgcaaatcccactatg

SEQ ID NO: 45243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatagtccgacagcagtgatcgacgagg

SEQ ID NO: 45244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatcgtatccggacccaggcttgaactg

SEQ ID NO: 45245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatcgtcgagctgtacgtgtaagtctgg

SEQ ID NO: 45246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatcgtgcagcttgagagccggtacgtc

SEQ ID NO: 45247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatctactctaggttgggatcgttctgg

SEQ ID NO: 45248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatctactggctactttggtttcggggt

SEQ ID NO: 45249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatctattgcgtcacggctcgtaggact

SEQ ID NO: 45250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatggtaagtccgcaatggacgtgggag

SEQ ID NO: 45251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatggtattttaatagtcacacggtcgc

SEQ ID NO: 45252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatgtcggagttgaaactcgtgaccgcc

SEQ ID NO: 45253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatgtgcttcaatttattcacccgatta

SEQ ID NO: 45254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcatgtgtatctgtcatgtctcccggttc

SEQ ID NO: 45255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcattagacgagcccagtggcaggagtgc

SEQ ID NO: 45256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcattgactcgcggtatcttcgaaaatgt

SEQ ID NO: 45257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcattggtcggcaagttggggtttagtcg

SEQ ID NO: 45258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcattgtgcgcgcggtaagtcgtgaatgt

SEQ ID NO: 45259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccaaaagaggatttacgttgattcatgc

SEQ ID NO: 45260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccaaagcaaacggacggggcgggggagt

SEQ ID NO: 45261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccaatttctcggtcaagatgcgttcagc

SEQ ID NO: 45262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccacaaattagtctagagtgtaggcgca

SEQ ID NO: 45263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccacaagatacgtctggctgtcacgatc

SEQ ID NO: 45264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccaccagtgtgatgcttgtctacggtag

SEQ ID NO: 45265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccagaacacgctccctcgcctcaggggg

SEQ ID NO: 45266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccagacagctcttgtacagctggacatg

SEQ ID NO: 45267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccagctagttgctcactggtgtgtgtgt

SEQ ID NO: 45268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccaggggtagattcccggacgttggtca

SEQ ID NO: 45269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccataacatctgactaaagaagtcacgc

SEQ ID NO: 45270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccatagcgtatacactgctcggacaggg

SEQ ID NO: 45271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccatgactggacaaccggcccaattgtg

SEQ ID NO: 45272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccattggagtgcacctaatgtaacgacc

SEQ ID NO: 45273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcccacgaggacccgaatgggccagcatc

SEQ ID NO: 45274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcccagggtgtgatccgctctgcggtagt

SEQ ID NO: 45275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcccagtaacatccgatgttcctgcgtgt

SEQ ID NO: 45276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcccccgggagtttcaataatcagaatcc

SEQ ID NO: 45277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccctacaggggagggtgctatacgatgc

SEQ ID NO: 45278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccctactcgtttaattcagttaacgttc

SEQ ID NO: 45279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccctacttctctttcgaataaagagttc

SEQ ID NO: 45280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccctcagctgaaacactagctatatccc

SEQ ID NO: 45281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccctgaattgcgcagtgtgcccacgtcc

SEQ ID NO: 45282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgaaacacgtcgaggagcagaaagccc

SEQ ID NO: 45283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgaaacacgttggccagcttgcggacg

SEQ ID NO: 45284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgaagagtgcctttcatattacttttt

SEQ ID NO: 45285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgaggatggcgccgggtatgcctccta

SEQ ID NO: 45286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgagtggatgacaggggacgcgggtcg

SEQ ID NO: 45287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgcagaccacagcctgtgaagttgctg

SEQ ID NO: 45288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgcaggaactagtccaggccagttgag

SEQ ID NO: 45289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgcgttggacgctgaatggggcatctg

SEQ ID NO: 45290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccggcctcccagaccatcgagcgattca

SEQ ID NO: 45291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccggtacgggtgcaacctgctttatctc

SEQ ID NO: 45292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccggtccctgcctggttttgctgtatat

SEQ ID NO: 45293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccggtgatatccagttacttcttcttgg

SEQ ID NO: 45294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgtggtgtctgcgtagcttcttccggc

SEQ ID NO: 45295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgttagcagtggtcggtccaaagccgt

SEQ ID NO: 45296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccgttgaacgggcgtaagcttgggccgt

SEQ ID NO: 45297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctaaggacgtcatgtgaagtccgaatc

SEQ ID NO: 45298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctcaaagagctcggctgtctcgccttg

SEQ ID NO: 45299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctcactagccaggttattacatcaccg

SEQ ID NO: 45300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctccgtttgcgcaaggtcgtggtgcgt

SEQ ID NO: 45301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctctaaacgtgcggtctgcccagaacc

SEQ ID NO: 45302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctctccggcaaccgcgtacccgagggg

SEQ ID NO: 45303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctctctgagttttctagtttgggtgaa

SEQ ID NO: 45304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctggacaaggttgcaactagaacggcc

SEQ ID NO: 45305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctggtaagttatccactatatgtgttg

SEQ ID NO: 45306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccttctacgtgtttcataagtttcttgg

SEQ ID NO: 45307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggccttggtgatacagatcgcatgtggagg

SEQ ID NO: 45308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcctttacaagcgggttatcacgcaggga

SEQ ID NO: 45309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgacacagttcgcggacggcttggattt

SEQ ID NO: 45310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgaccaccgaccggaaaaggggcttacc

SEQ ID NO: 45311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgaccagagcattcggggtaggggccgg

SEQ ID NO: 45312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgaccgtcaatgtggcgacacaaggccg

SEQ ID NO: 45313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgactcgggcctggtataaaacgtgcgt

SEQ ID NO: 45314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgagaatagcatggtacctggcgcagtc

SEQ ID NO: 45315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgagatctatgatccgagctaaatgttc

SEQ ID NO: 45316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgagggtgttagtgttgccggtagtgtt

SEQ ID NO: 45317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgagtatgaacgcgatcggggcggggga

SEQ ID NO: 45318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgatcacgcgtcgtaaatgacgaagccg

SEQ ID NO: 45319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgatcggcatcacgcgcctgagcatttc

SEQ ID NO: 45320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgatttatgtctcacaggtctctgaggg

SEQ ID NO: 45321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgatttggagtgtgttcacctggcgtct

SEQ ID NO: 45322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcaaggttttggcggtattttgggtgc

SEQ ID NO: 45323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcagaccgggataacgggacttgccgg

SEQ ID NO: 45324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcagtgaatttgagtcttgttgtttat

SEQ ID NO: 45325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcataggaaacgatgatacacgcggtg

SEQ ID NO: 45326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcatgaatatgtcggccgatatgtacg

SEQ ID NO: 45327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcattttaactcgactgcgtctctcgg

SEQ ID NO: 45328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcccgtgaagtcaggaaacgtggggtg

SEQ ID NO: 45329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcctcgagtatgttgttggctctcgaa

SEQ ID NO: 45330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcctggcgagcaactcccttctcgggc

SEQ ID NO: 45331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcgactaactttgcgtattgggatgag

SEQ ID NO: 45332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcgcatctcgattacccctagtttgat

SEQ ID NO: 45333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcgctcttttagatcccctccaaacac

SEQ ID NO: 45334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcggggagcagtcagttatcggttcgg

SEQ ID NO: 45335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgcgtcattccaagactcatccttacac

SEQ ID NO: 45336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgctaggtgaggtatccgggccgttatc

SEQ ID NO: 45337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgctcagatgatggcctggcaatatgct

SEQ ID NO: 45338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgctgcgtgacgtttgggcattttgtga

SEQ ID NO: 45339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggaagatggcagtgccgtgtaggagct

SEQ ID NO: 45340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggacgatacggtacggtctagttagtt

SEQ ID NO: 45341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggagcaaggcgtctggcaatctgaatg

SEQ ID NO: 45342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggagggcctctatgcatatacttgggc

SEQ ID NO: 45343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggaggttgtaaaaacatcagagggggc

SEQ ID NO: 45344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggataacgacggttgggatgggacctg

SEQ ID NO: 45345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggcaacggctggacctgcaagtcagtg

SEQ ID NO: 45346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggcagaatcgatttggttagcgagtgt

SEQ ID NO: 45347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggcatgcgaaagggataagccgaaggt

SEQ ID NO: 45348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggcggtttacattctggtgtgctcact

SEQ ID NO: 45349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggctgataagggcatgacgctttcatc

SEQ ID NO: 45350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgggaaccattgggccggccttctgctt

SEQ ID NO: 45351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgggagagaggtgtgatggcttcggggg

SEQ ID NO: 45352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgggcgaagatgcgttcttgatctgggc

SEQ ID NO: 45353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgggcggtctacgtttgtaagcagtgcg

SEQ ID NO: 45354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggggcaggagtgtcggctgggggttct

SEQ ID NO: 45355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgggtcaaacgtaaataggtcggccgtt

SEQ ID NO: 45356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggtatgttactgaccggatgaagagcg

SEQ ID NO: 45357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcggttagtaattgcttagggtgacgcac

SEQ ID NO: 45358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtaattgccacgtgagcgcgttgttca

SEQ ID NO: 45359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtaggtaccgtaaagtttcggtttatg

SEQ ID NO: 45360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtcagattcagaatgcgatgccaacta

SEQ ID NO: 45361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgcagatgaatcacactatatggccc

SEQ ID NO: 45362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgggctggatccctgcgcagaattgt

SEQ ID NO: 45363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgggtccacaaggggtcgttcgcgtg

SEQ ID NO: 45364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgtcatcggctgtacgggcttcgatt

SEQ ID NO: 45365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgtcctcggttttcgtggctgttacg

SEQ ID NO: 45366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgtgctaaccgtttacagtaactacc

SEQ ID NO: 45367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcgtgtgtccggtgttcggaggagaccca

SEQ ID NO: 45368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctacacgctgatggctgtttgacccgta

SEQ ID NO: 45369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctagcaggggccaccatagcatgaggga

SEQ ID NO: 45370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctagcgcggtagtcagaagcctactgta

SEQ ID NO: 45371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctaggtatttcgcggcacagatgccttt

SEQ ID NO: 45372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctagttggtcttacgagggtcttcgtgt

SEQ ID NO: 45373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctatacagtcccaaccggccattgcgta

SEQ ID NO: 45374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcatggcactggctgatggggttcgtt

SEQ ID NO: 45375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctccatcgggcaataatcggatgcgcgc

SEQ ID NO: 45376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcccggtaggtctgaaatcctattggc

SEQ ID NO: 45377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctccctcaggtcatcatgggatgcgaca

SEQ ID NO: 45378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctccgaatacagggtgggagatcaacgg

SEQ ID NO: 45379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcctagagttcagatctgtgttcttcg

SEQ ID NO: 45380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctccttttcggccaacagaccggcattg

SEQ ID NO: 45381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcgcaaaggaaactattgtgcaggcgc

SEQ ID NO: 45382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcggacgggcgggcagtgatcccgggt

SEQ ID NO: 45383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcgtgaatatgcaagtttatcgtatct

SEQ ID NO: 45384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcgtgccaggccaaacgtgactgtacc

SEQ ID NO: 45385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctctcgcgactcggacatcgtgacgttg

SEQ ID NO: 45386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctcttcatcacggtcgaggattcaggtg

SEQ ID NO: 45387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgaagataagcaaaccgcgggccaagg

SEQ ID NO: 45388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgagggatgcagggtgcgatggactgt

SEQ ID NO: 45389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgatgtcacgaatgacagtttctcgct

SEQ ID NO: 45390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctggacgaagtgttaagagtagatctcg

SEQ ID NO: 45391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctggacggtcggagacatatatgctcct

SEQ ID NO: 45392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctggcacggctggagtgctatgataggt

SEQ ID NO: 45393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgggggacatggacctgagcgattcgc

SEQ ID NO: 45394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctggggttacatcaattcattcgctcca

SEQ ID NO: 45395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctggttcgttaaaatcctttcttgtccg

SEQ ID NO: 45396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgtcccgttaccaggtgtaatttggtg

SEQ ID NO: 45397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgtgtccagttaacttgccgctccatc

SEQ ID NO: 45398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctgttaagccccagtccgattacatgtg

SEQ ID NO: 45399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcttactgtgctacctttttggaatcagg

SEQ ID NO: 45400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcttcgtgaccttcatcacgtacgggagc

SEQ ID NO: 45401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcttcttgtggctgtgccagaggtctggt

SEQ ID NO: 45402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcttgatggtgtaatgctctttcaatttg

SEQ ID NO: 45403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcttgtcgagtagtcagttcccacggacc

SEQ ID NO: 45404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggcttgtgatttacggtcaacatctcgccg

SEQ ID NO: 45405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctttccgttgccaatacgagggatctgg

SEQ ID NO: 45406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggctttctgtgaacatcgtcaggcgcctgc

SEQ ID NO: 45407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaaacgggctcacctggtaagcttgatg

SEQ ID NO: 45408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaaagcaggtaatcgtggacggcggttg

SEQ ID NO: 45409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaaccgatccgggattgctcgcagtctc

SEQ ID NO: 45410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaacggttcgcttactgtccggggattc

SEQ ID NO: 45411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaagaacagggagtgccggtaagtagac

SEQ ID NO: 45412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaaggattcagcgaccatcacggttagt

SEQ ID NO: 45413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaaggctgcattgtccgctcgtaatccc

SEQ ID NO: 45414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaataacgaatgtcaagcggcgattgca

SEQ ID NO: 45415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaataccggcatttactggccgccgtta

SEQ ID NO: 45416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaatccgtgatgtcggggtccccagttg

SEQ ID NO: 45417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaatcctcacacctcgcacagctttggc

SEQ ID NO: 45418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaatcggctggacgaggcatgttgattt

SEQ ID NO: 45419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaatgcgatgtgtcagctttgtggccgt

SEQ ID NO: 45420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggaattcgtggtatagttggggacagaaa

SEQ ID NO: 45421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacaagttcctacacggtctagcgcatg

SEQ ID NO: 45422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacacgaaccaatgactgatccgggcgc

SEQ ID NO: 45423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacacgtgtctatcatgtttcaggtcgc

SEQ ID NO: 45424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacatacgcgtcataagatatgaggcct

SEQ ID NO: 45425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacgaacagtgttgtcatgagtagtttg

SEQ ID NO: 45426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacgaataacagcggttcgcgcgtatgc

SEQ ID NO: 45427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacgacatgatgcgtggctggtcaatgg

SEQ ID NO: 45428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacgagtgtaagaagccgtaaagtccat

SEQ ID NO: 45429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacggaccatgttgcacgaaaatagtag

SEQ ID NO: 45430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacggggacaaagctacaactcaatccc

SEQ ID NO: 45431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggactcagctcagcagacggctatgtgta

SEQ ID NO: 45432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggactgttgcgaccgggtgttcgaacttc

SEQ ID NO: 45433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacttagcatcttgtgttggatgggcga

SEQ ID NO: 45434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacttgaccgatgacggacagattacat

SEQ ID NO: 45435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacttgggaaacaccgtgcgggggtcta

SEQ ID NO: 45436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggacttgtggccgatctcggctaaccgca

SEQ ID NO: 45437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagaacagtacaagttcgcgtgcgctag

SEQ ID NO: 45438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagcacatttgctaatgcgcagctgtgg

SEQ ID NO: 45439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagcatcgatgtggacggattgaagcgc

SEQ ID NO: 45440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagcgcgacagatctcgtagggcgaagt

SEQ ID NO: 45441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagcgtagaactgttcacatccgcctgc

SEQ ID NO: 45442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagctctcttttcacgacagtgtgatct

SEQ ID NO: 45443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagctgagatcgtgggggtgtgaaatgg

SEQ ID NO: 45444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagggaccggctcagcacgaatcccgac

SEQ ID NO: 45445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagggtacgcgaatgctgtgctcttgca

SEQ ID NO: 45446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagtaaggcggattcatatctcttccga

SEQ ID NO: 45447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagtagaatcacccctttggatcaccat

SEQ ID NO: 45448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagtctcggacaggttatccatgttgtg

SEQ ID NO: 45449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagtggccttgtcttatcgccctcacgg

SEQ ID NO: 45450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggagttcaacagttgctatctcggcaagg

SEQ ID NO: 45451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatacaacagtgagctatgcggacgtct

SEQ ID NO: 45452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatataaataccctggtagcactcatca

SEQ ID NO: 45453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatatcgactatgtaccttaatgcccgt

SEQ ID NO: 45454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatatggcagggcgttggcgagagaccg

SEQ ID NO: 45455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatcacgtcggacatgccgtgacttgcg

SEQ ID NO: 45456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatgacggggtaggaaactgcggaacga

SEQ ID NO: 45457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatgcattctggttatggctcacgttga

SEQ ID NO: 45458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatgctttacgctagccgatgaaaacac

SEQ ID NO: 45459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatggttacgctggtcgaatcgatggcc

SEQ ID NO: 45460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatggttctcacgtgagttaggcggagg

SEQ ID NO: 45461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggatgtgccggctcgctgctaagaggact

SEQ ID NO: 45462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggattggcgatggcatgcgtctaggtagt

SEQ ID NO: 45463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggattgggggccataggttcgacacgttt

SEQ ID NO: 45464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggattgggtcgttactcgagaattacagc

SEQ ID NO: 45465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcaactgacgtatcgcggaatccggaac

SEQ ID NO: 45466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcaagacgtcactaagtccccaagatcc

SEQ ID NO: 45467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcaatgcaacactcgtaaatacctggag

SEQ ID NO: 45468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcaatggcgtaacccggagtttggtatc

SEQ ID NO: 45469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcaccaggtagtcgactttctgctccct

SEQ ID NO: 45470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcactagataggactttactgactgacg

SEQ ID NO: 45471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcagcagtcgaggttgactgaccctcgt

SEQ ID NO: 45472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcataaattgttctctccgctcaggtac

SEQ ID NO: 45473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcatacaggttgattataggcggctttt

SEQ ID NO: 45474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcataccgtatggtgcgtaaaaggctgg

SEQ ID NO: 45475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcatcacgttatttcaataggcctcagt

SEQ ID NO: 45476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcatcaggcgtacgcatgggttgggttc

SEQ ID NO: 45477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcatcagggggttcagtgctcggtcaac

SEQ ID NO: 45478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcatcaggggtgagcaggaaccgtaccc

SEQ ID NO: 45479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccacccgaatttggcttgttgcggaag

SEQ ID NO: 45480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccaccgcagtgtgcagggtgtgtcagt

SEQ ID NO: 45481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccacgaattagggatgtatgtgcgcgg

SEQ ID NO: 45482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccagaaatgtgaattcctccggcggcc

SEQ ID NO: 45483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccagtgcggcgctgacatttcaaaggc

SEQ ID NO: 45484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccatccgcaaatgctgtcgtgctaaat

SEQ ID NO: 45485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcccgatgcgaacctggctgtgaagctg

SEQ ID NO: 45486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccctagcgggtgtcgtgccgggatgcc

SEQ ID NO: 45487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccctctcacgggtggcttccgaggtct

SEQ ID NO: 45488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccgactcaactttgcctcttctaacgg

SEQ ID NO: 45489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccgagagtgcaggggtggcatagcatg

SEQ ID NO: 45490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccgcagcgatgggtctgaattaaggtg

SEQ ID NO: 45491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccgtacgcctgcggtttactagctgcc

SEQ ID NO: 45492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccgtcctcctaggataggcaggtcaca

SEQ ID NO: 45493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggccgtcgcggtgagggtacttcaggaca

SEQ ID NO: 45494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgaccaggggacttatattgaacgcac

SEQ ID NO: 45495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgacggcttgagtcttcgaacttcgtg

SEQ ID NO: 45496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgagatctgtacggggcgggatcaggc

SEQ ID NO: 45497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgagggtctgttggaggagctaagtgc

SEQ ID NO: 45498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgatcgatcgcgggcaccattacgctg

SEQ ID NO: 45499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgccgacagcttatcaggaatgaagcg

SEQ ID NO: 45500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgcgcgggaatgctctgattttggcgt

SEQ ID NO: 45501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgcgtcaacgtccagagggggctttct

SEQ ID NO: 45502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgcgtgattgttgcgtgggcacgttca

SEQ ID NO: 45503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgctatagacgttccacaagtctgcgt

SEQ ID NO: 45504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgctccagctactggtcccgtaaatac

SEQ ID NO: 45505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgctggtgacaatgaagccgaggctgg

SEQ ID NO: 45506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgcttgtacttcggacttcggttgcca

SEQ ID NO: 45507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcggatgggcgtagtctcatccgtggtt

SEQ ID NO: 45508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcggtcgagcatgctgggtctaggtctg

SEQ ID NO: 45509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcggtcgggacagcatcgacaaatattg

SEQ ID NO: 45510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcgtgcgctcttcttgcgttccgatgat

SEQ ID NO: 45511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctacaatgcaaccctaaagcgtttggc

SEQ ID NO: 45512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctaggccatacatacgagcgagcgatc

SEQ ID NO: 45513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctagttgcacgagggtcggactgtgct

SEQ ID NO: 45514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctattgacatggtgcgtccggtgctgg

SEQ ID NO: 45515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctcaactccgtctgagtttgcgcttac

SEQ ID NO: 45516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctcacaacagttgcggtcgtggcgtgg

SEQ ID NO: 45517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctctcctccctggtcggttggatgttc

SEQ ID NO: 45518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctctgacctttccccgctgtaccctcc

SEQ ID NO: 45519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctgaaggatgtgtattgcagctcctta

SEQ ID NO: 45520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctgacgaacatccctgatatgttggac

SEQ ID NO: 45521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctgcaggctgcgttagcttggagtgtg

SEQ ID NO: 45522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctggaatgtataggagctacttccgcc

SEQ ID NO: 45523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctgttcactcaatcttgtttgcgcggt

SEQ ID NO: 45524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggcttcctttctggcattgtgaaacatag

SEQ ID NO: 45525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggctttaactagttaccgttggcttagac

SEQ ID NO: 45526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaaaacttgtgtgtggaacatttaggc

SEQ ID NO: 45527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaaatcagactctacgcgaaatcacgc

SEQ ID NO: 45528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaacgagctcggatccgtttcggtgac

SEQ ID NO: 45529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaagcttgcttagtcgagtacgctgag

SEQ ID NO: 45530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaaggacgaaaccaaaagcgggcctcg

SEQ ID NO: 45531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaagggtctggtatctctattattgaa

SEQ ID NO: 45532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggaagtaactcggcgtccttggtttctg

SEQ ID NO: 45533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggacgccccggttcagccgagtacctgg

SEQ ID NO: 45534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggagaggtggcgcatcatgagacggtac

SEQ ID NO: 45535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggagcccgtcgtgttgaactgcggccct

SEQ ID NO: 45536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggagctgtacggcatctactcatctgca

SEQ ID NO: 45537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggatatgtaggtacgaatcactgtgagt

SEQ ID NO: 45538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggatcacgtgggccgctaggttcttgtg

SEQ ID NO: 45539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggatcgatcgcatcgtgctacgttggcg

SEQ ID NO: 45540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggattcgctgtgtcggaacgtgctgggc

SEQ ID NO: 45541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcacccacccagcctagcctggttccg

SEQ ID NO: 45542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcaggagaaggctgtggcacctactgt

SEQ ID NO: 45543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcaggtcttagaatgataacaagggcg

SEQ ID NO: 45544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcagttgaggtctggtgttggacgtat

SEQ ID NO: 45545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggccgatcaagttagagtgggcacttcc

SEQ ID NO: 45546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcgagacacatgcgctacgatcagctc

SEQ ID NO: 45547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcgattgggcttgcattcacttgatgg

SEQ ID NO: 45548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggcttccatagcgtgtcttactgcgcga

SEQ ID NO: 45549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggaaaggcactggcacagagaagcact

SEQ ID NO: 45550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggaacggaggagtgtagtgagggtggt

SEQ ID NO: 45551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggaactgtggataatgggttattcagc

SEQ ID NO: 45552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggaagtcggattagaattcatctagca

SEQ ID NO: 45553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggacatgacggcagagctagattgtgc

SEQ ID NO: 45554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggacgcacacgacaaacaccccccttc

SEQ ID NO: 45555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggacggcaagtcgcttatgggcgcgcg

SEQ ID NO: 45556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggagcgtgtatcgtgtacgtgtggacg

SEQ ID NO: 45557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggaggtctactatagtgacgtgcggtg

SEQ ID NO: 45558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggcacttgcgtagtatccattcgggtc

SEQ ID NO: 45559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggcataaaacacgattcgcagctagga

SEQ ID NO: 45560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggcctggtttctttgcgaccgcattag

SEQ ID NO: 45561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggcgaggatgtccctccaatgcttcgg

SEQ ID NO: 45562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggcgggatgaggtaaatccgttcgcac

SEQ ID NO: 45563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggctgtgcttgtgtgccagaatgtggt

SEQ ID NO: 45564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggggtggaacggaccatcggaggtcaaa

SEQ ID NO: 45565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggggttttcgagtctctgtctatcatct

SEQ ID NO: 45566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggggtcgtgtatcgggctctttctcagaa

SEQ ID NO: 45567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtaaagccgggccacagagaggtggtc

SEQ ID NO: 45568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtacaggtcgtaggggcatactgagcc

SEQ ID NO: 45569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtaccgtttccgagctgcccgaacagg

SEQ ID NO: 45570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtaggcctcattcagggaatgtaggtc

SEQ ID NO: 45571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtatacagacatgcaggacgaccatcg

SEQ ID NO: 45572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtatatctggaggtttgggctcgtgca

SEQ ID NO: 45573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtattgacaagcgggtagaaaccaccg

SEQ ID NO: 45574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtccatttgtgtcatcattcgggggcg

SEQ ID NO: 45575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtcgctcggcgcggatgaatgcactct

SEQ ID NO: 45576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtcgtctgcaatggttttcgccgctgc

SEQ ID NO: 45577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtgaaaagaagatgctgtctggtttga

SEQ ID NO: 45578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtgagaagcgcgatgggggacgcactg

SEQ ID NO: 45579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtgagccggccactccaaatcgtaccg

SEQ ID NO: 45580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtgagtaacgtagccggctacggggag

SEQ ID NO: 45581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtgcagtgatcgactagctcgaaattg

SEQ ID NO: 45582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtggaatggggtgtggggaaggtccgc

SEQ ID NO: 45583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtggaggccctggtttcgcaggtgtat

SEQ ID NO: 45584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtgggcgtaagggaaacccgcggaacg

SEQ ID NO: 45585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtggtgtaaacggggtaatttatgggc

SEQ ID NO: 45586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggttcatataaagacctgctcttgcgct

SEQ ID NO: 45587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggttcgagtgtttggatatactctagat

SEQ ID NO: 45588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggttgtttggagcgtatgagcccggggg

SEQ ID NO: 45589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggggtttatgtcagcatcaaacggaacatt

SEQ ID NO: 45590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtaagaattatggtgcagggggtgtctg

SEQ ID NO: 45591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtaaggcgggggtgtaccccgttaggtg

SEQ ID NO: 45592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtaatttggaggctgcgtgggcgatagc

SEQ ID NO: 45593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtacagtcgacgcaacggactttcatcg

SEQ ID NO: 45594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtagaaatgccgtcttccactagcaatc

SEQ ID NO: 45595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtaggcgcaatagttcgtggtttggagt

SEQ ID NO: 45596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtagtagtgggtcaacgctcactttgag

SEQ ID NO: 45597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtatggcaagatttacgtaatgcttttg

SEQ ID NO: 45598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcaaccaacccctgttgcctccctcat

SEQ ID NO: 45599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcagcgaacaggatgtacttcttagtc

SEQ ID NO: 45600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcatctggaggcatcttcatctacagc

SEQ ID NO: 45601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcatggtgtctggtgggagtgtttgtt

SEQ ID NO: 45602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcatgtgtagtgcggtcactttccggc

SEQ ID NO: 45603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcccccatggttagccgcggaaaaacg

SEQ ID NO: 45604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtccggatggggacatggattgccatac

SEQ ID NO: 45605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtccttaaatggcaaatacagatgctac

SEQ ID NO: 45606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcgcaacgtgggtcacaacatgccgat

SEQ ID NO: 45607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcgcaagcacggagcgggagacaattg

SEQ ID NO: 45608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcggccgttgacatcgcgttacctgga

SEQ ID NO: 45609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtcgtcaactagctatgggaggcggttt

SEQ ID NO: 45610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtctaaacgcattcataggcatcgcggc

SEQ ID NO: 45611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtctggctggtaagtataccccggcaat

SEQ ID NO: 45612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgaactctgtaaagtttgcgttcagca

SEQ ID NO: 45613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgacggatctccccgacaagcggaggt

SEQ ID NO: 45614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgcactcacgtgcgttccggttgttcg

SEQ ID NO: 45615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgcagatcaccgtggctctcctcgggc

SEQ ID NO: 45616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgcccactgattcgggaactgcaatgt

SEQ ID NO: 45617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgcggtgaacggcaaggccggttcctg

SEQ ID NO: 45618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtggccagtatagatcgcctgctgttcc

SEQ ID NO: 45619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtggcgggaccttttgtaactcattccc

SEQ ID NO: 45620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtggcttatgctgatggcctttcgttcg

SEQ ID NO: 45621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgggtggagcgtgacccaggttagcca

SEQ ID NO: 45622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgggtttggaacgaggttggtctttac

SEQ ID NO: 45623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgtacggggtcagtcgtctagcacgtg

SEQ ID NO: 45624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgtgggaatgcttagagctgccgcgga

SEQ ID NO: 45625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtgttgacctaatagatctatgcagtca

SEQ ID NO: 45626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttaaggcggcacgaggctggcagcccc

SEQ ID NO: 45627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttaatccgcattagcatcatggccata

SEQ ID NO: 45628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttcgcggtctctgatacggcccgcgtc

SEQ ID NO: 45629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttgaagccagcaaacactggagcatgt

SEQ ID NO: 45630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttggacgtggtaatcgtatcacggcgg

SEQ ID NO: 45631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttgggccggcctgatcctgcgtgactg

SEQ ID NO: 45632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttgggtgatggtcaccgccgttcgccg

SEQ ID NO: 45633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggttgtgatctgttaagagacggagttcc

SEQ ID NO: 45634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtttacacgggggtaacaattattcagc

SEQ ID NO: 45635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgggtttccaattgtcgcggtcacacagtcg

SEQ ID NO: 45636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaaacgatgagtaagttatctaccttgc

SEQ ID NO: 45637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaacactctcgacggggcattcagggcc

SEQ ID NO: 45638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaactgcggctcaatatcacatgcacag

SEQ ID NO: 45639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaatcggttccctaatctttgaggggaa

SEQ ID NO: 45640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaatttgggtgcccaggaattcaaagat

SEQ ID NO: 45641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaccttagccttaccaccattttcgaac

SEQ ID NO: 45642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtacggtagaggacgaacatgtgtggtcg

SEQ ID NO: 45643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagacacaggtgggattactctccctca

SEQ ID NO: 45644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagacgggcaggcttgttgaggaggcct

SEQ ID NO: 45645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagacggtggtcgatggggtttgtttga

SEQ ID NO: 45646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagcaaatgtgcgatacgggggccagcg

SEQ ID NO: 45647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagcacccattcagaactgtgggcgatc

SEQ ID NO: 45648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagcatgccggtcttggcactttctata

SEQ ID NO: 45649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaggaacacaccgtatttttcttgtgtg

SEQ ID NO: 45650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaggatcaagtagcgagcaggtagcgtg

SEQ ID NO: 45651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtaggccgcgaggcgtctgtaggagcggt

SEQ ID NO: 45652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagggtgcattcgggggcgtctgcttta

SEQ ID NO: 45653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagtaaacacacgtgacatgaattaggc

SEQ ID NO: 45654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtagtgacaagctagacggccgaatgttt

SEQ ID NO: 45655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatcgaaccaagcgcttgggggatataa

SEQ ID NO: 45656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatctcaccaaggttgctgccagggcta

SEQ ID NO: 45657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatctctcgatagatagggtctagggcg

SEQ ID NO: 45658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatgattactggttatcgttcgatgccg

SEQ ID NO: 45659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatgcacccaggctgttcatgtagaatg

SEQ ID NO: 45660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatgcatctcgtgttcggtgtcccgcgc

SEQ ID NO: 45661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatgccccacagtacatgtatggatgca

SEQ ID NO: 45662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatgtcggcaatcgagacttgtcaggcg

SEQ ID NO: 45663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatgttcatagtaagcataagggggtac

SEQ ID NO: 45664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtattctcgtaggtgggctagaccacgca

SEQ ID NO: 45665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtattgtcataatcgggacgggacgggac

SEQ ID NO: 45666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtatttggatgtgtttaaattgggcagta

SEQ ID NO: 45667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcaccaaggttgcgctatcctgtgctgt

SEQ ID NO: 45668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcaccagacgagttggagggagcacgtc

SEQ ID NO: 45669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcacggctgcacactttgcgaagatacg

SEQ ID NO: 45670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcagcgagattttgtcgttctcaatacg

SEQ ID NO: 45671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcaggtagatccaggctgcgatacctac

SEQ ID NO: 45672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcagttattttgtagtagtttgtgtgtc

SEQ ID NO: 45673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcagtttaactgcagatggagcttgatc

SEQ ID NO: 45674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcattcgtaatgtccaggcgattgtgac

SEQ ID NO: 45675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtccgggttgggtattcacagctctgtcg

SEQ ID NO: 45676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtccttacgaggggattccaaaccgggcg

SEQ ID NO: 45677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgaatatcatgaggggttgagggcacg

SEQ ID NO: 45678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgacacgtgcgcagttttatgggcggg

SEQ ID NO: 45679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgacttttcatattgggaatatgtcac

SEQ ID NO: 45680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgagcactcgtctttctccggtcgttt

SEQ ID NO: 45681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgaggcggccccaccgatgctttcgcc

SEQ ID NO: 45682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgagggaggcggtgatcgctcgtgtcc

SEQ ID NO: 45683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgcgtctatgccattgggacagcagct

SEQ ID NO: 45684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcggagcgcatagaggcttgcagcgcgg

SEQ ID NO: 45685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcggcaaggagtagcggtggaggggtat

SEQ ID NO: 45686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcggtcaaatgtgtcatccagcgttcgt

SEQ ID NO: 45687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcggtccaacgtcacttcgtgatgtctc

SEQ ID NO: 45688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgtccagttccagatccacgcaacgtg

SEQ ID NO: 45689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcgttcgtgcggttctgtgttccaggca

SEQ ID NO: 45690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtctagggatgaatttattgccatcatgc

SEQ ID NO: 45691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtctgcattgaggtgagtgtatttgacga

SEQ ID NO: 45692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtcttccgattgcatttttcgttgcacta

SEQ ID NO: 45693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtctttgctggataggcgtgtgtttggcg

SEQ ID NO: 45694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgaacggcacactcgaaggatttggggc

SEQ ID NO: 45695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgagacggaatgaagcggtgagttcggc

SEQ ID NO: 45696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgagctagagataaggcccaacgcgtag

SEQ ID NO: 45697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgagctatcacgaccggcacgatgagct

SEQ ID NO: 45698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgaggcatggccgcgtggtccaccatcg

SEQ ID NO: 45699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgaggttgcgggcccaccattgtgtgct

SEQ ID NO: 45700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgagttgacgtatatcggtgatgcccgt

SEQ ID NO: 45701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgatattacggtatgttgtttggatcgc

SEQ ID NO: 45702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgatgacggagaggcctccttccgtgtg

SEQ ID NO: 45703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgatgctaagcttaatacgcctctagcg

SEQ ID NO: 45704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcaagttccgactcatgtccacctgtt

SEQ ID NO: 45705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcaccgaaggtagttagcgagcttcgg

SEQ ID NO: 45706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcatgttgtaatgggcttcgtttagtc

SEQ ID NO: 45707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgccggcacgcgattcgatgtcaggcgg

SEQ ID NO: 45708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcgatggggccgctgctgaggtcctcc

SEQ ID NO: 45709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcgcagttggtgtgtcgaagtgaaggc

SEQ ID NO: 45710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcgccgggtactgcatggaatcgcgtc

SEQ ID NO: 45711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcggcgctggcttgtgaacactctaaa

SEQ ID NO: 45712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgcgtgccatgtttcagtatatgttctt

SEQ ID NO: 45713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgctatgtttttgtcggcgcttgcttat

SEQ ID NO: 45714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgctcctctgcagactgtatgcccttta

SEQ ID NO: 45715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgctttctcacacgcgagctcgtaccac

SEQ ID NO: 45716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggactctaagagcagaggagggtgcgg

SEQ ID NO: 45717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggagatggggaccgcgggagatacaga

SEQ ID NO: 45718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggagcccgctcctcatcaagttgaccg

SEQ ID NO: 45719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggagtatagcatttcatcccggtaatg

SEQ ID NO: 45720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggagttcactgcatacgtaggtacttg

SEQ ID NO: 45721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggcaaacctgttgccttcccaaagcga

SEQ ID NO: 45722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggcaactgcacaactggttcgtaccac

SEQ ID NO: 45723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggcacagggtaagccagggtatcgatt

SEQ ID NO: 45724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggcatgtgaacccgcgttgtcatcgtg

SEQ ID NO: 45725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggccacttgtacgacaggagtcagttg

SEQ ID NO: 45726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggccattgctgctccttgttggctcct

SEQ ID NO: 45727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggcccatttccgaatgcaggtggcctt

SEQ ID NO: 45728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggcgatgaacctcgactggaacccgcg

SEQ ID NO: 45729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggctgggcagcttattctggtgacgta

SEQ ID NO: 45730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgggagaaactgaaggatgctccagccc

SEQ ID NO: 45731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgggatatgtgaggtcctcggactgaat

SEQ ID NO: 45732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggggggaagtgattgggagaatggccc

SEQ ID NO: 45733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgggtgcgaggctgaagcttggcgtgcc

SEQ ID NO: 45734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtagatatgcggcaaagctttacacc

SEQ ID NO: 45735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtcatcctcaggttgctggtccgctg

SEQ ID NO: 45736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtctgctctgttggttcgataccagt

SEQ ID NO: 45737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtgaacctacttgccaggcatatgag

SEQ ID NO: 45738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtgaccggagcggctcagcagagggc

SEQ ID NO: 45739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtgactgcaatacgtcccgaggaggt

SEQ ID NO: 45740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtggcaacgtagaagcaacttccaag

SEQ ID NO: 45741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtgggctgtttgtgtgttatcgacga

SEQ ID NO: 45742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtgtcaacactacaaccgttaagggc

SEQ ID NO: 45743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggttcggttgatattgttgctgtactg

SEQ ID NO: 45744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggttctcagtggtcgacgggaactgca

SEQ ID NO: 45745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtggtttgttgagagtcgctgttctgtgt

SEQ ID NO: 45746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtaacgtgcgcattctgtcctcgaccc

SEQ ID NO: 45747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtagagcttcatgacctgggtggggtg

SEQ ID NO: 45748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtcggccctcgaggtttatagctgacc

SEQ ID NO: 45749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtgatggcgttagggggctggaagtca

SEQ ID NO: 45750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtgcaggggccaggtgacatcgagggc

SEQ ID NO: 45751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtgccagacggtccacagaatccactt

SEQ ID NO: 45752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgtggcgccacatttcttcggctcgatt

SEQ ID NO: 45753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgttatcgcttatacgttctgcagtcgc

SEQ ID NO: 45754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgttcggaacgcgcttgaaggaaagggc

SEQ ID NO: 45755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgttgaacgcggcaaggcaagcagggag

SEQ ID NO: 45756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgttgagttataagggtgccgacaggcg

SEQ ID NO: 45757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtgttttgctccagttctccgagtattcg

SEQ ID NO: 45758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttaataaaagagctcgcctgcatccggt

SEQ ID NO: 45759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttacaccactgtactacgggcacggtct

SEQ ID NO: 45760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttacgaacagtcaagaagattctgtgcg

SEQ ID NO: 45761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttacgagctgaggactattgagcgcggg

SEQ ID NO: 45762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttagccgaatcgggtgtattcagtaggc

SEQ ID NO: 45763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttagggttctccttgtgccgtgtgtgat

SEQ ID NO: 45764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttatgtaagcgacttctttccgcagatg

SEQ ID NO: 45765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttatgttagggcacacttattagcgctt

SEQ ID NO: 45766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttatttgcgtagggtcttcaagggtctg

SEQ ID NO: 45767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttcaaacgtctcttgttaacggagggat

SEQ ID NO: 45768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttcagcggccaccaataattcaagtctt

SEQ ID NO: 45769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttcgaggttttttacttaaatggggggt

SEQ ID NO: 45770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttcgtggcgggtgtactcgatgcggatt

SEQ ID NO: 45771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttctaagttctcgttcacctcttgctgc

SEQ ID NO: 45772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttctaggggccacgcggtcaacgattag

SEQ ID NO: 45773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttcttggtggcagttgttttacatttat

SEQ ID NO: 45774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgaccctcataaccatcacacctggaa

SEQ ID NO: 45775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgacctagaagggacagtcgcgggggg

SEQ ID NO: 45776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgagccatagaagaaggcccgttagcc

SEQ ID NO: 45777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgcatcgcatacacgtgcgagaaacgg

SEQ ID NO: 45778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgccgttcaatcaagttctcggttcac

SEQ ID NO: 45779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgcctagtcgaggaaagcctatagtcg

SEQ ID NO: 45780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgcggcggagcgtcataatggggtacg

SEQ ID NO: 45781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgctatccggctcgtggtccgccagta

SEQ ID NO: 45782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgctctatgagtgcacagtgtatattt

SEQ ID NO: 45783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttggagacgatgcgggtacacatgcgtg

SEQ ID NO: 45784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttggcatcgcaagtttctgcgtgtactc

SEQ ID NO: 45785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgggtagcacagcaggagtcatgatgg

SEQ ID NO: 45786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttggtgttgccccagtgctgaccgcagt

SEQ ID NO: 45787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttgtgcacaacatggattgcggaggacg

SEQ ID NO: 45788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttaaacggattccggcagataagattg

SEQ ID NO: 45789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttaagtcgctgtggcctcatgctctac

SEQ ID NO: 45790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttaccagaattgcgaatctgagtcctc

SEQ ID NO: 45791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttactctttcacttatgcaattggttt

SEQ ID NO: 45792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttagcattcaacatggattttccctcg

SEQ ID NO: 45793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttcgggttcggtgggtcgcgtcaatct

SEQ ID NO: 45794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggtttggcccataaggatgtgtgtatgtcg

SEQ ID NO: 45795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttttaaactccacgggcccgactcaggg

SEQ ID NO: 45796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttttcctggttcaatgaaatgtaccgtt

SEQ ID NO: 45797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcggttttctgcttcgggtcggaccgggggtt

SEQ ID NO: 45798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaaagcaggcggctcgctagttgtttca

SEQ ID NO: 45799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaaagcggcactgtcatagactcgctcc

SEQ ID NO: 45800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaacagctatcaccgttttctttcccgc

SEQ ID NO: 45801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaacggcgagttgatcatccctagctcg

SEQ ID NO: 45802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaactccagccctagccggcgtcagttg

SEQ ID NO: 45803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaactcggcaatagtatgcttgttccgg

SEQ ID NO: 45804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaacaagttcccaaagggtgactctgagc

SEQ ID NO: 45805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaacagcaacatcgcggactaggagcgtc

SEQ ID NO: 45806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaccagggatagtccgggtgaagctgtg

SEQ ID NO: 45807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaccggtagatagactgatgggggctcc

SEQ ID NO: 45808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaacgaacctgttccccaagaaaggtata

SEQ ID NO: 45809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaacgaagccttgtcaggtgcgggtgtta

SEQ ID NO: 45810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaacgtaacataccatgtttgcgccgcgg

SEQ ID NO: 45811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaacgtgcgccgggcattcacggctctgc

SEQ ID NO: 45812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaactcatgttgcagtaggctttggggga

SEQ ID NO: 45813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaagccggagtgagctcaatcaagggtcg

SEQ ID NO: 45814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaagcttccgtcaggcacgcgcgtctaga

SEQ ID NO: 45815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaaggaacagtttgctcgtgagtcttcgt

SEQ ID NO: 45816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaagtgaggcaacggtttattctttgacg

SEQ ID NO: 45817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaagtggggcgatggatattataatcctt

SEQ ID NO: 45818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaatatcatcttccgggaacgcatgcagt

SEQ ID NO: 45819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaatcaccattagactcttcgctatcagt

SEQ ID NO: 45820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaatggcaaattcgaaatattctgcgtgt

SEQ ID NO: 45821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacaacgtgtgacaggctcttggatagca

SEQ ID NO: 45822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacaccattcttatgctggaggagtgcct

SEQ ID NO: 45823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacacttctcggctcgatattccgtgttc

SEQ ID NO: 45824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacagaaggctcacgggtccgatacctcg

SEQ ID NO: 45825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacatggtagtgcatttgggcaatcccac

SEQ ID NO: 45826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacatgtcggagggagggtgccaaacgcg

SEQ ID NO: 45827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacatgttcagtaaggcagtcgtcatccc

SEQ ID NO: 45828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacccacgacagaatggttgcaatgggtc

SEQ ID NO: 45829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacccgtctttgggtcggtttcttctgct

SEQ ID NO: 45830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaccggcgctgtggaggggaggtaacacg

SEQ ID NO: 45831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaccgggacttagtgccgaggttgttccg

SEQ ID NO: 45832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaccgttttcacgtggagtctgtttgcaa

SEQ ID NO: 45833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacgcgggcacaaacaactctgctgtggg

SEQ ID NO: 45834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacgctccgtccggtgggcacctccggca

SEQ ID NO: 45835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacggatcgtggcgtcagggctagttagg

SEQ ID NO: 45836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacggccagaccgtggtgaacttcttggt

SEQ ID NO: 45837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacggtctttcacctcctctgcctttgcg

SEQ ID NO: 45838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacgttggagagcaaacgtagacgcctcg

SEQ ID NO: 45839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtactacttcgcaattatgtgccgcagctt

SEQ ID NO: 45840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtactggttatttgacttcttggtacacaa

SEQ ID NO: 45841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtactgtcaaccccggtcatcggtccctcg

SEQ ID NO: 45842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtactgtgctctatcccgttgtagtagacc

SEQ ID NO: 45843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtacttacatagctcgagttcaataggtta

SEQ ID NO: 45844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagaatagtcgacgcatatctcaggatct

SEQ ID NO: 45845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagacagaccgacttgcagcctcggcgat

SEQ ID NO: 45846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagacatatacgatgagactatgaaggtg

SEQ ID NO: 45847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagagtccgaagcgcgaaactccaggagc

SEQ ID NO: 45848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagcaggatggtggtagctcttgtgtcgc

SEQ ID NO: 45849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagcgatcgtcccgggaaggtgatctcgc

SEQ ID NO: 45850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagcgggactagcgactactatgcaccac

SEQ ID NO: 45851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagctgctcggatcaaagtgctcaactct

SEQ ID NO: 45852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagcttatgtcttgccgaatggggatgca

SEQ ID NO: 45853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagcttctgacgcgtcaaactgagggtct

SEQ ID NO: 45854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggaagaggtgacgctgtagcgtctggt

SEQ ID NO: 45855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggaggacatcgtaagaacagcttgttg

SEQ ID NO: 45856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggcaatcggtagacgccatgaaattct

SEQ ID NO: 45857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggcctggccacaccttgcaacagtggg

SEQ ID NO: 45858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggcgtaatctatacggttgttccacct

SEQ ID NO: 45859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggcgtgccggcatgactttggtgcgac

SEQ ID NO: 45860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagggccgcgatcagatgggtacccagca

SEQ ID NO: 45861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagggcggtggctggttgaggacaccccg

SEQ ID NO: 45862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagggcgtatacggatgcggcgttctatc

SEQ ID NO: 45863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagggggtctgagcgcgtgaagtccggta

SEQ ID NO: 45864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggggtttctcggcagggactagtcatc

SEQ ID NO: 45865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggtatcaggtgtctgtcaattttatcg

SEQ ID NO: 45866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggttgatctcggcaggtccgtgtggta

SEQ ID NO: 45867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtaggttggaggtggatagtacgcgtggtt

SEQ ID NO: 45868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagtcaaagtgcacagggaaggcgcagtc

SEQ ID NO: 45869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagtcccgcttattttcctcagtcggcta

SEQ ID NO: 45870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagtctgtacgtcggaactatatcataag

SEQ ID NO: 45871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagtgcgcgaatcagtcatcatgctgaga

SEQ ID NO: 45872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagttcaagcggacggctccaggctgtgt

SEQ ID NO: 45873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtagttgtcgcagaaacacggttggaactg

SEQ ID NO: 45874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatactcatcgtctccctacagtggagtg

SEQ ID NO: 45875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatagaacttctgcggaatcatattagac

SEQ ID NO: 45876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatagcacctttccgaaccacggagactc

SEQ ID NO: 45877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtataggcggaggccgaagtcgggccgtta

SEQ ID NO: 45878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtataggcggccgagttgcttaccgtgcac

SEQ ID NO: 45879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatagtacgccgattccatcggaagaccg

SEQ ID NO: 45880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatatgcgcataggcttacaagatgatta

SEQ ID NO: 45881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatcgagtatgcttgtcgtaatcaatgat

SEQ ID NO: 45882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatcgctctgtgccactgctgcccggtct

SEQ ID NO: 45883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatcgtgtctgtgcgggcaaggctgtggg

SEQ ID NO: 45884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatggcgggtaattcgtggatcgcataat

SEQ ID NO: 45885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatggcgggtcggcatcgtggtctaaaaa

SEQ ID NO: 45886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatggctgatggggaaatccaccgtacgt

SEQ ID NO: 45887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatggggcggtccaccagtcgcaggaagc

SEQ ID NO: 45888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatggtcgaagttaccacggggcgcgatc

SEQ ID NO: 45889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatgtcattagggcctttatttgcgtatc

SEQ ID NO: 45890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatgtcttggtaacccagtatcgggccta

SEQ ID NO: 45891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatgtgatggccccccgtctggagtagca

SEQ ID NO: 45892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtatgttgtatcctaacgtcgctaagtccg

SEQ ID NO: 45893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtattcattcaccacctaggctgacccgtg

SEQ ID NO: 45894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtattcgaatccgctgatgaggggtagacg

SEQ ID NO: 45895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtattgaccttctgttctgcctccaaacgt

SEQ ID NO: 45896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtattgcgagttgtgttggatttatgtagg

SEQ ID NO: 45897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaaaatgccagatctatcgcaccgcaat

SEQ ID NO: 45898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaaatggcggcccctgcaagctggtcct

SEQ ID NO: 45899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaagcgttggagtggtgggattgcgagg

SEQ ID NO: 45900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaagctctgctttctggcagggaagtgc

SEQ ID NO: 45901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaagtttcccccgacgggaaggatccgc

SEQ ID NO: 45902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaatggggcttgtttgcgagccatggcg

SEQ ID NO: 45903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaatgttcagctatcggttgagtcttct

SEQ ID NO: 45904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcacactctctgcacaattttcctccgtc

SEQ ID NO: 45905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcacagtcgatagtcgaaagtacgaaacc

SEQ ID NO: 45906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcacctccagagcgcccaaggctagtttg

SEQ ID NO: 45907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcacgcatgcgatcgtgttacctgatgac

SEQ ID NO: 45908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcacggaaacacagaccggacttctgttc

SEQ ID NO: 45909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcactattgcagctcgcacgtttagctcc

SEQ ID NO: 45910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcactggtgatgccgggtcactatcacat

SEQ ID NO: 45911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcacttctgctccgcatgaggcgtggtgc

SEQ ID NO: 45912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcagcagccatcacgctagaactctgggc

SEQ ID NO: 45913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcagccgatcctcgtcgtgaacggaattg

SEQ ID NO: 45914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaggcacacgagattgcagccgtcctag

SEQ ID NO: 45915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaggtaagcaaaacagatcaggttcgat

SEQ ID NO: 45916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcaggtgtacagtttggtccggtcatggc

SEQ ID NO: 45917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcatcactacctgcactgttaacggtcac

SEQ ID NO: 45918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcatcggactcctgagcggcggggtgtcg

SEQ ID NO: 45919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcatcgggtagggagactaacttctacgt

SEQ ID NO: 45920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcatgacatcgaattccgcgtaaagggag

SEQ ID NO: 45921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcatggactagtgcgaaaagaggcagcgg

SEQ ID NO: 45922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcatgggcggggagtcggccaactttcgt

SEQ ID NO: 45923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcattccccagtatagacgtgcaagctgg

SEQ ID NO: 45924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcattggcggcacatttacagtacaaaga

SEQ ID NO: 45925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccaacagtcgttcagggctcacctttac

SEQ ID NO: 45926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccaactttatatcttgataagcgtttcc

SEQ ID NO: 45927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccaccattgcttgctacggcgtgttgtt

SEQ ID NO: 45928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccacccgccttaagcttgttttgtctaa

SEQ ID NO: 45929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccagagatgctcatcgcgtagagactgg

SEQ ID NO: 45930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccagtggttttccgattctactggagtt

SEQ ID NO: 45931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccatctaccggttcaacgaaagtgaagt

SEQ ID NO: 45932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccattgtgtggtaaggtaggaacctgga

SEQ ID NO: 45933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcccaacagtggtggcaccagacggccgg

SEQ ID NO: 45934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcccaattgttgcgatatggtaggttgtt

SEQ ID NO: 45935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcccctccattacttttccgttcggtgtg

SEQ ID NO: 45936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcccggatcccgatatggtaccgaggtct

SEQ ID NO: 45937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcccggtgcactggactgagggtgtattg

SEQ ID NO: 45938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcccgtggaatccgttctaaccgggatga

SEQ ID NO: 45939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgaactgtcggtaagatagctagctgc

SEQ ID NO: 45940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgaaggcaacgtaacttcttgttgcgc

SEQ ID NO: 45941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgatccccggttactttgtctgattgg

SEQ ID NO: 45942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgcctatactttgaccgtccacatctt

SEQ ID NO: 45943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgctataggggagtattccgggtgggc

SEQ ID NO: 45944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgctggtgggttttgttgcctacctcc

SEQ ID NO: 45945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccggccaccaccagtcgctgctacgcca

SEQ ID NO: 45946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtccgggttctctaccgtgatgcctctcgg

SEQ ID NO: 45947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctaaactcctcgcgattccagtgggtg

SEQ ID NO: 45948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctacctttttattacgggcgttggggg

SEQ ID NO: 45949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctcatctttaggtaggttttcgacccg

SEQ ID NO: 45950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctcccaagtgatacgggatgaagatct

SEQ ID NO: 45951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctgagcgtactcttttgatgccgtcgt

SEQ ID NO: 45952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctgtctttcctccatcgtgacttatcc

SEQ ID NO: 45953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcctgttgtcacaaactggcgtaggcgat

SEQ ID NO: 45954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgaatgagtactgtgtgttagcggggtc

SEQ ID NO: 45955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgaccatcgcgaaccactttcctgctat

SEQ ID NO: 45956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgaccgtagtccgggacatagaaatact

SEQ ID NO: 45957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgacctggtttggagcactacccgttag

SEQ ID NO: 45958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgacgagcgggtgttgactttaatgtcg

SEQ ID NO: 45959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgacggtcaagtgccatcagaggacatg

SEQ ID NO: 45960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgactcgctattatcgaataccaggcgg

SEQ ID NO: 45961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgagcacggagcctgggcatttgtggtg

SEQ ID NO: 45962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgagcacgtccattgatcagtagtcctt

SEQ ID NO: 45963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgagggtcgagatacagtaatttacaat

SEQ ID NO: 45964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgcgacatcgctacggaaccgaccagct

SEQ ID NO: 45965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgcgcggaggtcatctcgtcaaccttgt

SEQ ID NO: 45966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgcgggccagcatactccacgtgactta

SEQ ID NO: 45967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgcgggtgccgctacaggtacgtgctgt

SEQ ID NO: 45968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggatacccagatgcgttgacccaagcg

SEQ ID NO: 45969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggcgcttagatcggttaaacgtgccga

SEQ ID NO: 45970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggcgggttcatcggtgcggtttggctc

SEQ ID NO: 45971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgggcactatgttttgctggttcgctct

SEQ ID NO: 45972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggggcggatatgtagacactcttttgt

SEQ ID NO: 45973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggggggcggagttgaggagtggtacac

SEQ ID NO: 45974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggtaaggttcaagcagccggaccatag

SEQ ID NO: 45975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcggtcgtgctttgctcaaaccagtgcgt

SEQ ID NO: 45976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgttcagcgggttctaaagggtgcgttt

SEQ ID NO: 45977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcgttttggcacatgggcgaatcaacgcg

SEQ ID NO: 45978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctaaggggctccacaagacggtgccagg

SEQ ID NO: 45979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctatgcgttatcaggttgtcatattctc

SEQ ID NO: 45980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctatgcgttggttgtttccagatgttgc

SEQ ID NO: 45981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctcacctgtactgcgacgaacgggtggc

SEQ ID NO: 45982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctcatgtgcatgcccccaggatggcgcg

SEQ ID NO: 45983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctccacggcaagacatcgctgcgggaat

SEQ ID NO: 45984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctcttggaggacccaggtacggacagtt

SEQ ID NO: 45985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctgatggtagcatacttggcataccgta

SEQ ID NO: 45986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctgcgtttcgagctacgggtcatccgcg

SEQ ID NO: 45987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctggtatgacggcaggcgttgcgttggg

SEQ ID NO: 45988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtcttgtagaacggcttgacgcgacgggtt

SEQ ID NO: 45989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtctttaatttgtgtgttagctgttcctac

SEQ ID NO: 45990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaaaacgggtactcggggtaggagcagg

SEQ ID NO: 45991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaaacaagactaagagaatgcggaagtt

SEQ ID NO: 45992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaaagcccatgattctggcgagtgtatg

SEQ ID NO: 45993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaacaatgccggaagccgaaagcgcccg

SEQ ID NO: 45994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaagcagacggaaatcaagcgccgggcg

SEQ ID NO: 45995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaagggagaccaaggtgggacttggcgc

SEQ ID NO: 45996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaagggtttccgttggtggggttatcca

SEQ ID NO: 45997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaagtgacccagtaacggaccgacgctt

SEQ ID NO: 45998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgacgaagaaatctgtgagagtggggccg

SEQ ID NO: 45999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgacggtgtttgtctcggttgtccaataa

SEQ ID NO: 46000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgagctgtatgcggaacgggagctcggtt

SEQ ID NO: 46001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaggaggtcgctaaaacacggcaggatt

SEQ ID NO: 46002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgagggatcttgccaactacgtattgccg

SEQ ID NO: 46003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaggggcacagtaacgagtcacgggtgg

SEQ ID NO: 46004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgaggtcatggccattcgtagtcagcaag

SEQ ID NO: 46005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatccaccctctcgttccgtgtgctgcg

SEQ ID NO: 46006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatctgcggtattgagtgctgttcgagg

SEQ ID NO: 46007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatctgctgtgagatgccttgcccttga

SEQ ID NO: 46008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatgggctcgacagagagtcattactgc

SEQ ID NO: 46009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatgtagcgtgtgtgttttatctcctta

SEQ ID NO: 46010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatgtcttgtgtaaagttggaattgtgg

SEQ ID NO: 46011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgatttcgggagatgataatcgtgatgcc

SEQ ID NO: 46012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgattttttgcgttcataattaggcagtg

SEQ ID NO: 46013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcaagttcagccacttcgttcaatatgt

SEQ ID NO: 46014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcaatcgacagatcggtttttgggatta

SEQ ID NO: 46015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcacacggacctagtgccttctccggcc

SEQ ID NO: 46016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcacccaggaacttttttaatcgtcgtc

SEQ ID NO: 46017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcactgctcctcctcggtggatgcattc

SEQ ID NO: 46018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcagaaacgcacaaattgcactccgttg

SEQ ID NO: 46019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcagcgcgccgagcatggtttcccgccg

SEQ ID NO: 46020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcagctcggcgttgatccggacttccca

SEQ ID NO: 46021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcaggacaggcgtcagttctcgcgcttc

SEQ ID NO: 46022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcagtttagaaatgcggttcggtaggtg

SEQ ID NO: 46023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcattgccgaattccgagcactcttagg

SEQ ID NO: 46024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgccatggtcatacaatagggcttgtacc

SEQ ID NO: 46025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcccatgcggtgcaggggagtttattac

SEQ ID NO: 46026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgccccgtagttctatcatttcgtggtgc

SEQ ID NO: 46027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgccggccagctcggagtttgttttgtct

SEQ ID NO: 46028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgccggtgcgatgggatccacgggggagt

SEQ ID NO: 46029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgccgtagcgttccgtaatgctgctccat

SEQ ID NO: 46030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcctcatgaggccccgttttaaagggga

SEQ ID NO: 46031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcctgggcggggtctagcgactgggtgt

SEQ ID NO: 46032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcctgtttagaccttggtaatcgtgatt

SEQ ID NO: 46033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgaaggccaatccgctgcttcggttgt

SEQ ID NO: 46034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgacagtttaaaacccatgggtggggg

SEQ ID NO: 46035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgagaaacgaaggaaggtactgtgttg

SEQ ID NO: 46036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgataccgttcaagcgaccaacgtctt

SEQ ID NO: 46037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgataggtcggtaatggcaggctctcc

SEQ ID NO: 46038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgcataggacagggacaagctccgagg

SEQ ID NO: 46039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgggaagcgtctttcgctttcgtctgc

SEQ ID NO: 46040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgggctagttcgctcgttttcgagagc

SEQ ID NO: 46041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgtaggtatgatatgatggacaatggg

SEQ ID NO: 46042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgtcgagtagtgattatcaggaagagg

SEQ ID NO: 46043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcgttcgggactcataccggccaggctg

SEQ ID NO: 46044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctagccaggctgagcggaggatcgcag

SEQ ID NO: 46045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctatgctgcacgaggcgaccggggagg

SEQ ID NO: 46046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctccggcggggggtaaacgtaatctgt

SEQ ID NO: 46047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctcctccgtgtcgacgagggcagttca

SEQ ID NO: 46048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctcgatgaaagcattgcctacaaccta

SEQ ID NO: 46049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctcgttttgtgcgtgaagctgtactca

SEQ ID NO: 46050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctgcggtgacataagagcgtcaatgcc

SEQ ID NO: 46051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgcttgtgcggcagcaatgcgtgagtttc

SEQ ID NO: 46052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgctttgaatcaggatcctcgcaattggc

SEQ ID NO: 46053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggaacccggggtcgtcaagtgagcttgt

SEQ ID NO: 46054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggaagctttgccctcctggtcttggtgc

SEQ ID NO: 46055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggaagtttgatccgtgtacaccctggaa

SEQ ID NO: 46056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggacagcaacgcgggtttagcctggcgg

SEQ ID NO: 46057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggaccaggggtgccgtaagaaacgacct

SEQ ID NO: 46058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggaccgggacactcttgagtagggttgg

SEQ ID NO: 46059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggacgttactgtccgattggggcttcgc

SEQ ID NO: 46060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggagcaagtggcgcgtgctgaatgcttg

SEQ ID NO: 46061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggaggtgggacgggttatctggccgggt

SEQ ID NO: 46062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggagtcgcgagtccatccttcggtatcc

SEQ ID NO: 46063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggattaggtggagtcaggacaactgtcc

SEQ ID NO: 46064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcaattcgtcgttaggatgttggttat

SEQ ID NO: 46065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcagggatatcgtttacgactttattt

SEQ ID NO: 46066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggccttagtaagtgatcagaggtgagta

SEQ ID NO: 46067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcgctcgttgacaagcagaacatcagt

SEQ ID NO: 46068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcgggagtacatccactgagaatccgt

SEQ ID NO: 46069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcgggcaacggtcaacgggaggaagct

SEQ ID NO: 46070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcggtaattatatgcgtcccgtgggtt

SEQ ID NO: 46071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcgtgcgaattcaacggcgataaagcg

SEQ ID NO: 46072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcgttcatcatggtttcagttctgtgt

SEQ ID NO: 46073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggctcgaactatatgttgcgggccccgc

SEQ ID NO: 46074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggctctggtctgatatgctctgatcgtc

SEQ ID NO: 46075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcttcaagcgctcgtgtcgggagatcg

SEQ ID NO: 46076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggcttgctttctgtgctgttgtgcacgc

SEQ ID NO: 46077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggaggaggtgtaactattgcgaggtcg

SEQ ID NO: 46078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggaggatgagctggtgcagaaggtgcg

SEQ ID NO: 46079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggaggcaatgacactgacggcgcacgc

SEQ ID NO: 46080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggattcaacgtcgcggtcctctcactc

SEQ ID NO: 46081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggcccaccagtctagtaatgcgtgttc

SEQ ID NO: 46082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggcgggggcttcccactgtgcaggagc

SEQ ID NO: 46083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggggtccgcggtatagtaggaaacgtga

SEQ ID NO: 46084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgggtctctcccggtggccttagtgccgt

SEQ ID NO: 46085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtagcggtgccttcagaggtgtgggcg

SEQ ID NO: 46086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtcacgtaacactgggttagactgggt

SEQ ID NO: 46087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtcccgtgggctttagcttgtgtcaac

SEQ ID NO: 46088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtccttggagggcgtagggttcgttgt

SEQ ID NO: 46089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtcgtagatggcatgatcgagacggtg

SEQ ID NO: 46090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtgatgcgaacgtactctgtttcggag

SEQ ID NO: 46091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtggacctcagacagccatcgtcttgg

SEQ ID NO: 46092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggtgtacaaggcatcgcaaggggagtat

SEQ ID NO: 46093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggttcgacgcatgtgtatccagctccga

SEQ ID NO: 46094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggttcttatgttttaaggttgacaggtc

SEQ ID NO: 46095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtggttgctgctccatgtagacctcgatgg

SEQ ID NO: 46096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtaagagacgttggcgcttgagtgcgct

SEQ ID NO: 46097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtacagtctaaagtatcacgtgggcctt

SEQ ID NO: 46098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtacatgtgcaatctgaagggttattgg

SEQ ID NO: 46099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtacgcgtcaccggatggttcgtaagcg

SEQ ID NO: 46100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtacggacgggcgaccctagtcaggcgt

SEQ ID NO: 46101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtacgtggtcgacctgtactcgatgatt

SEQ ID NO: 46102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtaggtcgcgagcactatcctaggcaac

SEQ ID NO: 46103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtagttcgattagtgatagagggcggag

SEQ ID NO: 46104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtatacttgtacttggtaacagccggtg

SEQ ID NO: 46105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtattagtgggcagctgtgcttttgatt

SEQ ID NO: 46106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtccatgcaaagcgggccttggatcgac

SEQ ID NO: 46107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtcccgatatgccggttgagcagtaacg

SEQ ID NO: 46108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtcgaaacagtaacatgttcactacagc

SEQ ID NO: 46109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtcggtcccaaaggccacattcaggggg

SEQ ID NO: 46110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtcgtccgggcgtaaccgcagattagcc

SEQ ID NO: 46111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtctacttaaatgtgctccgggcttctt

SEQ ID NO: 46112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtcttgtggcacctttatgttcgacgtg

SEQ ID NO: 46113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtctttcctccgtccactgcaaatgcgg

SEQ ID NO: 46114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtgcaagggctccatattcctcacgagt

SEQ ID NO: 46115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtggacacagaggcgggggtccgaggcg

SEQ ID NO: 46116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtggctaagcgcctaagtcttggctcgg

SEQ ID NO: 46117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtgtgtgcagagtggtttcgtatttacg

SEQ ID NO: 46118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtgtgtggacaagggctccctctgtacg

SEQ ID NO: 46119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtgttcatcacgaggtgcgtccaacgcg

SEQ ID NO: 46120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtgtttgatctagaacgcgatgtatgca

SEQ ID NO: 46121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttaaggagacagatgttaatccttggg

SEQ ID NO: 46122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttataacccatcccctgagaggcggtg

SEQ ID NO: 46123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttcaaacgagccagattccgtcgtacg

SEQ ID NO: 46124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttcccctctatgggtttgctcacgggc

SEQ ID NO: 46125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttccggacttgatagtcccgctgcatt

SEQ ID NO: 46126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttctaagtatctgctttagcgggcgtc

SEQ ID NO: 46127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttctgtgagtgcgtttcgggggtagtg

SEQ ID NO: 46128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttgatcggcgtcgcacgctcgcgtcat

SEQ ID NO: 46129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttgccggagttgccttgtgactgcttg

SEQ ID NO: 46130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttggatgctctcattcgccgcagccta

SEQ ID NO: 46131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgttgtctcgagcctttcccgtgtcaggc

SEQ ID NO: 46132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtgtttgcacactcggaggaaggcggactt

SEQ ID NO: 46133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaaaaatttcgtcgttgtaagcgctgaa

SEQ ID NO: 46134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaaaagtcccctcacgtctagtcttgtg

SEQ ID NO: 46135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaaacgcagcactgcccacagctacgcg

SEQ ID NO: 46136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaagactacctgtcatcgaacaaaggtc

SEQ ID NO: 46137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaatcttaattcgttacgcttacgacgc

SEQ ID NO: 46138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaatggtctaaattagacatcgccacca

SEQ ID NO: 46139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttacaaaaggctcgttctttgccgggggc

SEQ ID NO: 46140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttacacatctcggtttcctctcgtgtgtg

SEQ ID NO: 46141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttacattgcaactctgagaactattaaca

SEQ ID NO: 46142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaccgagaggccgacgtattctcattgt

SEQ ID NO: 46143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaccggtcactacgttccgaactccgca

SEQ ID NO: 46144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttacggctggtttgtggagcacatgcttt

SEQ ID NO: 46145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagaagtattccgtctggctgtaagtga

SEQ ID NO: 46146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagaatccatccgcctggtaaaatgctt

SEQ ID NO: 46147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagactggaggacggagcatcgggattc

SEQ ID NO: 46148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagcaagctatccccgtcggattcgtga

SEQ ID NO: 46149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagcagaacgcaccacgcctttccgcgc

SEQ ID NO: 46150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttaggatctggaacataacattatggagc

SEQ ID NO: 46151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagtacattacataatagcaacgggggg

SEQ ID NO: 46152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagtatccttgagcatgcccccctaccc

SEQ ID NO: 46153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttagtgccggccacatacgcacccacgca

SEQ ID NO: 46154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttataaagatccggctgggcagttgcgtt

SEQ ID NO: 46155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttatacagcggcagcctccttgtggcgtt

SEQ ID NO: 46156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttatacccttgtgttctgtacttcaatga

SEQ ID NO: 46157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttatgactcgtcttggatagggcagtggt

SEQ ID NO: 46158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttatggtgggcctactctttatgtgtggg

SEQ ID NO: 46159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttattagggttcggacgaccggggtgtct

SEQ ID NO: 46160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcaagtgtctagctgtacctgcgtgtgc

SEQ ID NO: 46161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcacaccaatacagaatatgaagtcagg

SEQ ID NO: 46162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcaccctgcgctctttctatactcaaga

SEQ ID NO: 46163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcacctcgcttgttttcaaaggtccgca

SEQ ID NO: 46164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcaccttggtaggttcattacgatgcgc

SEQ ID NO: 46165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcactggcacacttgatgtgatcgttga

SEQ ID NO: 46166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcagaaccagcactcttctatggttggg

SEQ ID NO: 46167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcagagtctctaggtgtagcgcgaggcc

SEQ ID NO: 46168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcaggcccattcctgtactcgttgagta

SEQ ID NO: 46169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcaggcttgctcatgcgggttgtttttg

SEQ ID NO: 46170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcagtcgtctactagcactgaatctcgc

SEQ ID NO: 46171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcatgacttttccagtccctgctttttt

SEQ ID NO: 46172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccacattctaaacgctgtttagcctgg

SEQ ID NO: 46173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccaggcccgggaagtgcacacgtaaat

SEQ ID NO: 46174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccagggggcggatcgatttactgttca

SEQ ID NO: 46175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccccctttttggaacctacttgcgctt

SEQ ID NO: 46176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcccgaggtaacggcactaatgccttct

SEQ ID NO: 46177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcccgatgattcaatcctcgtttggttg

SEQ ID NO: 46178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccctattctcgcgagctttctggcgca

SEQ ID NO: 46179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccgagcgctcatcggaaggattcggac

SEQ ID NO: 46180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccgatatacatttattgtcgacacgga

SEQ ID NO: 46181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccggaacgtgtctcatgctcggcggta

SEQ ID NO: 46182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccggacaggaatacccatctgcatgcc

SEQ ID NO: 46183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcctactccacgactctcccaggtaatg

SEQ ID NO: 46184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcctcagacaatcttttgccaatatgtc

SEQ ID NO: 46185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcctctgggccaatcgggttcacgctgc

SEQ ID NO: 46186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttccttaacttaacctgggtccttaccta

SEQ ID NO: 46187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgaaaatgcgtgttaatgctggcttct

SEQ ID NO: 46188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgaattggaggctgacaccgatttgaa

SEQ ID NO: 46189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgactttcgcgggacattggggaatac

SEQ ID NO: 46190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgattctgtggctaagtcatcctccat

SEQ ID NO: 46191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgccagcgcactgtcggagcttttgta

SEQ ID NO: 46192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgcggtacgggagcgtcatggggctct

SEQ ID NO: 46193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcgctctcaaggggtgcatttgggcggt

SEQ ID NO: 46194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcggaacggacgaatacggcgtgtgcgt

SEQ ID NO: 46195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcggcaggaccgatcaggcgatttttgc

SEQ ID NO: 46196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttctaaaacccggccgtcgctactgtggc

SEQ ID NO: 46197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttctgactgcgacactacgcttatgatta

SEQ ID NO: 46198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttctgcgatgttacgttcgcatcatttgc

SEQ ID NO: 46199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttctggcgtaagggtccaagcacttttac

SEQ ID NO: 46200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttcttgtgtcgcgggggacaattacgtgc

SEQ ID NO: 46201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgaaggggtaggcggtcgggttgagcgg

SEQ ID NO: 46202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgacgtatgatgctagagccatgttggg

SEQ ID NO: 46203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgacttataccccctcgttatcatcaga

SEQ ID NO: 46204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgagatcaaggtggacgcctgccgtttg

SEQ ID NO: 46205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgagccgaatcaaggtttcgaataatgc

SEQ ID NO: 46206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgagtagtagtgaaacaaccttgtccga

SEQ ID NO: 46207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgatattgtaagttggatcgggatagtg

SEQ ID NO: 46208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgatcacctgcatgagactcattggcct

SEQ ID NO: 46209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcaccggagttgaggtgacgctcagcg

SEQ ID NO: 46210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcagcctcaacgttacggtgggaatcg

SEQ ID NO: 46211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcattacgtatccctcgtgaggatgca

SEQ ID NO: 46212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcattcatccggtttcaggaagtgtca

SEQ ID NO: 46213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgccacttcacatgggccatgcatcgat

SEQ ID NO: 46214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgccgatcgtaagactggctcagtcctt

SEQ ID NO: 46215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgccggtctaacgggcaaactatggaac

SEQ ID NO: 46216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgccttgcacgcttgcataggaattcga

SEQ ID NO: 46217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcgaaaagcagtggatcgttcgttacg

SEQ ID NO: 46218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcgaaactcattaataagccttatttg

SEQ ID NO: 46219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcgaataccgtccacatctgacctagg

SEQ ID NO: 46220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcgacccactcgggttcggttgtccga

SEQ ID NO: 46221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcgctactccatgtctacgcccgcctt

SEQ ID NO: 46222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgcgctcagtggagccgagtttgtgggg

SEQ ID NO: 46223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgctctctcaatgtctaacggggcttaa

SEQ ID NO: 46224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggacgtagcttaacctttcatagtcgg

SEQ ID NO: 46225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggaggactaccaatcgacagcgaagag

SEQ ID NO: 46226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggattgatttgcatgactttgggcatc

SEQ ID NO: 46227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggcaagcctagggggctgcgagggcga

SEQ ID NO: 46228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggccctatctagactgtgccccgagtc

SEQ ID NO: 46229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggcgatggtgtgtattgtggtcgggcg

SEQ ID NO: 46230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggcggtcacacgggaaaatctcagaca

SEQ ID NO: 46231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggctgctagtcggcgcagtgacggggg

SEQ ID NO: 46232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgggatgctgtcgtaattggcggtgctt

SEQ ID NO: 46233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgggcagtatgatgatgtttgtggtcgg

SEQ ID NO: 46234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgggcttagtttcaccttttctggtccc

SEQ ID NO: 46235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgggcttcgtctgccgcttaacggttgg

SEQ ID NO: 46236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggtacggggtcttggtaagttacacgc

SEQ ID NO: 46237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggtcgggccatactgtttttgtccgtt

SEQ ID NO: 46238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggtggtttgccggggttctgtttgtct

SEQ ID NO: 46239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttggttcgaaaggttaacttaccactagt

SEQ ID NO: 46240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtaaggcgagtaatagtagcgactcgt

SEQ ID NO: 46241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtactcggtgtgctttacccgtcgtct

SEQ ID NO: 46242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtatgcagtcatgcctctggaagtagc

SEQ ID NO: 46243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtcgagcacattgagattgagcgggga

SEQ ID NO: 46244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtctaagttaatggacttcggggagtg

SEQ ID NO: 46245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtgccttactgtgatgtgctgagcgtg

SEQ ID NO: 46246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtgcggttatttgggcataatttattc

SEQ ID NO: 46247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgtgttttgttaggccaccagttaacac

SEQ ID NO: 46248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgttcgatgtctcatggggcgtttctgg

SEQ ID NO: 46249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttgttgtcactgtacgttcgtgatcgcct

SEQ ID NO: 46250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttagaggtcaggagtcgttaggcgcatg

SEQ ID NO: 46251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttaggacggccttggatcaatcctcgcg

SEQ ID NO: 46252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttataagcggtcatacaaatgctctgcc

SEQ ID NO: 46253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttcagtggtatgggtcctatattcactc

SEQ ID NO: 46254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttctctggatctcctacacgaccaggtg

SEQ ID NO: 46255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttctgccggctggttaatgcgacaaggg

SEQ ID NO: 46256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgaatagtgcctatttggcaccgagtc

SEQ ID NO: 46257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgagatgggtggcaacgcaaggccctg

SEQ ID NO: 46258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgaggtaacgtttgttaattatgtggt

SEQ ID NO: 46259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgattcccccactccggcggctttgtt

SEQ ID NO: 46260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgcaactccgtagtttcccgtattgtt

SEQ ID NO: 46261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgccgagccggttattaggggtatgtt

SEQ ID NO: 46262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgcggaagacaaggtagggggtcgccc

SEQ ID NO: 46263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttgtgcttgctcaaacccatcttggact

SEQ ID NO: 46264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttttatgagtatatgttagtttgcgttac

SEQ ID NO: 46265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttttccggtggctttattgtgtgtgacgt

SEQ ID NO: 46266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttttgacgggggacgtcgcattacagacc

SEQ ID NO: 46267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttttgatgcttgcacgggagaccggcccc

SEQ ID NO: 46268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgttttgttcggcataccggtaatcccctga

SEQ ID NO: 46269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcgtttttgcgtcccggctaacatttagcttc

SEQ ID NO: 46270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaaagcgcccagggctcggggccgctccg

SEQ ID NO: 46271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaaatgccgttcgtagttcccgtatgaac

SEQ ID NO: 46272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaaattaactaacaatagggtgattacct

SEQ ID NO: 46273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaactgtaaacgctgcaggctactgtgaa

SEQ ID NO: 46274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaaggtggtggggtgcacgtcactacagg

SEQ ID NO: 46275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaaggttgctggactgtttcatgccctgg

SEQ ID NO: 46276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaagtaacgctgttctgactgtctttgca

SEQ ID NO: 46277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaatcaaagcgcgtccgtgtggtaattta

SEQ ID NO: 46278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaatcaaggacagctcccccgaggcgtta

SEQ ID NO: 46279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaatgcgttacgatgactgtgttcactcc

SEQ ID NO: 46280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacaccctggctaaatgaaagttgtgcct

SEQ ID NO: 46281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacacgaaggcgggacggcccatgcgccc

SEQ ID NO: 46282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacagcgtcacgatccgatcgcatgtgtg

SEQ ID NO: 46283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacaggagacagtgcataatttgatgctt

SEQ ID NO: 46284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacagtcggtgagagtacacgggtgcgct

SEQ ID NO: 46285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacatagttgcctgggagtcaaccggtca

SEQ ID NO: 46286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccaactgctcgcgttccagcgaattcg

SEQ ID NO: 46287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccccgatctgttagcaggttcttcaat

SEQ ID NO: 46288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccctatgacggacaggttcgggcaatc

SEQ ID NO: 46289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccctcaccatgcgaagcactccaccga

SEQ ID NO: 46290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccgcagccgtcctctcgataatcatct

SEQ ID NO: 46291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccggcacatcaatcctcctggtgcccg

SEQ ID NO: 46292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccgggtcaatggtaattcgggtcacgt

SEQ ID NO: 46293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaccgtacaacggcacggggtaatcatgg

SEQ ID NO: 46294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacctgtccttgatttccccactaggcgt

SEQ ID NO: 46295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacggaatgactgctttgtgcctgaagct

SEQ ID NO: 46296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacggaattttgcttccatttggaatcgc

SEQ ID NO: 46297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacgggtcatggtaaaagagttatcgcta

SEQ ID NO: 46298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacggtggactcctcgtggtccgggtgcc

SEQ ID NO: 46299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacgttttagttctggtctaatttgcgca

SEQ ID NO: 46300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaactattagtacgtactaaggacatccac

SEQ ID NO: 46301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacttgcctggctcgttgcgttgcaccgt

SEQ ID NO: 46302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacttggacaattctctgctgcatccgac

SEQ ID NO: 46303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacttgtgtcagctagattgggcttatca

SEQ ID NO: 46304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaacttgttcccaccttccgtttggagccg

SEQ ID NO: 46305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagaccaattgaaggtagtcatgttggct

SEQ ID NO: 46306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagactacggtggaggcatccatctaggc

SEQ ID NO: 46307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagagttcttgctgcagagagtttggtcc

SEQ ID NO: 46308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagcaataatccggcaaatttacgggcta

SEQ ID NO: 46309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagcaatttagcatggcctgccacctgat

SEQ ID NO: 46310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagccagtgtcgttcaaatcatagaaaca

SEQ ID NO: 46311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagcccagctcgagtacgagcagtcgagc

SEQ ID NO: 46312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagcgagttcttggatgcggcataacggt

SEQ ID NO: 46313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagctatgccgtctccattacactgccgt

SEQ ID NO: 46314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagctcagtccgtatgagcagagaagagc

SEQ ID NO: 46315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaaggcggtcaaggggcagagtggtagttg

SEQ ID NO: 46316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagtaaataaaaggttagacaagacgggg

SEQ ID NO: 46317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagtccggcgccgatcattcacttcattc

SEQ ID NO: 46318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagtcgtagatgctaggggcttatggtac

SEQ ID NO: 46319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagtgcagctctgactctgtcccgggtcc

SEQ ID NO: 46320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagtgtagctcggggattcgggcttgatc

SEQ ID NO: 46321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaagtgtgtgggagttagccttcacggtcg

SEQ ID NO: 46322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaataatggtgcccggttacgaggaggatg

SEQ ID NO: 46323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatcgagaagcattttgtactaacctatg

SEQ ID NO: 46324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatgagaaaggtttggtgggcagggtcgg

SEQ ID NO: 46325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatgagccgcgcaagcgccgatctgagcg

SEQ ID NO: 46326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatgcgcgacaacagtggaatgtgatttg

SEQ ID NO: 46327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatggacgtggtacgcttgcagggctcac

SEQ ID NO: 46328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatggaggacggtgacctagagctcgtag

SEQ ID NO: 46329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatggcggtcgcgcctcagtcggatgagc

SEQ ID NO: 46330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatgtccctggtcccggcagagggcgtat

SEQ ID NO: 46331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatgtgtcatgccggtgaccttcagacgt

SEQ ID NO: 46332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaatgtgttccagtcaggttcctgcgccct

SEQ ID NO: 46333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacaaccttttggctgctatagattgcgct

SEQ ID NO: 46334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacaagaccgtgcgtcctcccgtcagatcc

SEQ ID NO: 46335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacaaggtgcgggctcggccagtctcgtcc

SEQ ID NO: 46336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacaagttagcaatttctctggacgtggtt

SEQ ID NO: 46337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacaataccggttcggagggcgtgcagctt

SEQ ID NO: 46338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacacatcagtagcaaaggggagggccgag

SEQ ID NO: 46339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacacgaaggtgtctaaatgtccggtacgg

SEQ ID NO: 46340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacacgaatccctctcgagactctccgcgg

SEQ ID NO: 46341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacactattcacgcgtcatttgttcgtgtt

SEQ ID NO: 46342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacactggagtccctggttgcgctataatt

SEQ ID NO: 46343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacactggttatgacccgtagcttgaggcg

SEQ ID NO: 46344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagaaagactattatcgtactgctggac

SEQ ID NO: 46345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagcaccggaaccgatgccgggaagggg

SEQ ID NO: 46346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagcagcgcgtcaactcgcagcggcatt

SEQ ID NO: 46347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagcattttgtttgtgctctttataacg

SEQ ID NO: 46348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagcgaagagcgtaccggacacaaccaa

SEQ ID NO: 46349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagcgatccctacagcggggcttgcacg

SEQ ID NO: 46350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacaggtcggcgcgtcgcgcgggtcttagg

SEQ ID NO: 46351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagtatgttgtcctttagctatcctaaa

SEQ ID NO: 46352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacagtcagcggagttgcgtaatggctgag

SEQ ID NO: 46353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacatctcgcccggggagagtcatgccaca

SEQ ID NO: 46354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacatgaccggttactcgtacaagcttgtg

SEQ ID NO: 46355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacatggtccctcgtggggatgcttcatgt

SEQ ID NO: 46356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacattgttccaggggggatcgcgttttac

SEQ ID NO: 46357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccaaagcggtcgtgatagaagggctcgg

SEQ ID NO: 46358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccaccgcagagtcaatactactgggatg

SEQ ID NO: 46359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccacgtgacagtgtccccgtataaatta

SEQ ID NO: 46360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccatcgggcattatcggcgagaagtccg

SEQ ID NO: 46361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacccactcatccccatgtagggcgttcac

SEQ ID NO: 46362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacccagtatcggactacaatgacctttgc

SEQ ID NO: 46363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacccagtgcgactgtacgtctcatggctt

SEQ ID NO: 46364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccccgcggagatgggctttgccggacgg

SEQ ID NO: 46365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacccgctccattgcgttgtgtatctaggg

SEQ ID NO: 46366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacccgcttggcagtagaacgtactggatc

SEQ ID NO: 46367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccctcgtcggtcaggcccagcttggttg

SEQ ID NO: 46368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccctgtccatcggaacttctcgcgcaca

SEQ ID NO: 46369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccctgttagttttatggtggatttcgtt

SEQ ID NO: 46370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccgaccgggactttgttagtatgtggtt

SEQ ID NO: 46371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccgccgggcagccatcggtttctcgccg

SEQ ID NO: 46372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccggcacgcgatgggccacataaagggt

SEQ ID NO: 46373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccggtgcccgccctttgtgtttgcccgt

SEQ ID NO: 46374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccgtaagacgttttgtggaggtgacgtt

SEQ ID NO: 46375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccgtcgttttcgatgatcacctatgctg

SEQ ID NO: 46376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccgtctaggcaagtagttatagcgctgg

SEQ ID NO: 46377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacctgaggttgatgttaagccgttggtta

SEQ ID NO: 46378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacctggctggtcgacggacgggcacggac

SEQ ID NO: 46379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacctggtaagccgttgtgtggtacagccc

SEQ ID NO: 46380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaccttcccccctgtctcggctggttactc

SEQ ID NO: 46381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacctttttaattggcggatgtctcgttgt

SEQ ID NO: 46382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgaacagcgtgtcaaaagtgaatcttct

SEQ ID NO: 46383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgcagtctttgcgcctggtgtttgatgc

SEQ ID NO: 46384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacggacgattggatgttcttgttttgcac

SEQ ID NO: 46385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacggactgcaatagatgtcaaggctaaga

SEQ ID NO: 46386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacggagccgtgaagctaaaactctcgttc

SEQ ID NO: 46387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacggctcgactcttgcgctggctacctct

SEQ ID NO: 46388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgggcccgttcctcgttccgctctgctg

SEQ ID NO: 46389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgggctagttgtagaggtgtgttcacct

SEQ ID NO: 46390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacggtccaaaccaaacgaaacggcgctgg

SEQ ID NO: 46391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgtaacccgtcctggatcgccaccaatg

SEQ ID NO: 46392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgtatacaaccgaagctccacggtagga

SEQ ID NO: 46393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgtggcaacacgttttgggcgctacttt

SEQ ID NO: 46394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgtggttacgcacatatgtgtgggctac

SEQ ID NO: 46395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacgttggggcgataaagttgcaattgctg

SEQ ID NO: 46396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactacgcttcaagcgttaacaagattgtg

SEQ ID NO: 46397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactacgggcggcacctctgaaacttgtga

SEQ ID NO: 46398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactagagtcacatcctcactatgcggagg

SEQ ID NO: 46399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcacacagcgtttacgacgggcagggt

SEQ ID NO: 46400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcccattacggaaggttaggcggacct

SEQ ID NO: 46401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcccgcgcggctgggttatgttctggg

SEQ ID NO: 46402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactccttagcgcgagggggtgtttcgggc

SEQ ID NO: 46403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcgcaccccctgagcgttggctaaata

SEQ ID NO: 46404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcggaagctttcctattcagtgcatgt

SEQ ID NO: 46405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcgtctctcccgcattgccggctcgtc

SEQ ID NO: 46406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactcgttcaggactattacttcatatgtg

SEQ ID NO: 46407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactctgttgggttctgcggtcggagccgg

SEQ ID NO: 46408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactgatgaaaacgagctggtgcctgcggt

SEQ ID NO: 46409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactgcgcgatgtattccacgaatataccg

SEQ ID NO: 46410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactggcaaagcgagctcattgttaccccg

SEQ ID NO: 46411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactgtgataataggagcataggtgcctta

SEQ ID NO: 46412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactgttggagtgcatagaacgatcgcgcg

SEQ ID NO: 46413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacttatacacgcacagtgatctcccggca

SEQ ID NO: 46414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacttccccttcatttagtcgccaagttgt

SEQ ID NO: 46415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacttcttctatgccagggtaagctcggga

SEQ ID NO: 46416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacttgggacgcagctgctgatgggttgac

SEQ ID NO: 46417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacttgggcttcgcgttcttatggtcgttt

SEQ ID NO: 46418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctacttgtgacccagtaccgttttttctgtc

SEQ ID NO: 46419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctactttgtcggtataactcgcgtcctctcg

SEQ ID NO: 46420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagaaacatgattagccgtgcagtgtcggg

SEQ ID NO: 46421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagaacgacacggtttatgcggtcgctccg

SEQ ID NO: 46422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagaactgtacagctcggcggcaacatttc

SEQ ID NO: 46423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagaataccatcgtgtgaacacgtctaatt

SEQ ID NO: 46424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagaattgcgcgatcttcgggggcatgctg

SEQ ID NO: 46425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagacagtccgagccacatcagtgttgtga

SEQ ID NO: 46426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagacgaaaccaagagccaggcgaggggcg

SEQ ID NO: 46427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagacgttcggccgaatcgctaacaaactg

SEQ ID NO: 46428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagagagggataggagggtggacattactg

SEQ ID NO: 46429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagagcatatgcgtttgcctcggcctcgga

SEQ ID NO: 46430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagagggggtgttgtgtgccatgctatatg

SEQ ID NO: 46431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagagtacgctggagctctgcaactgtgga

SEQ ID NO: 46432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagagttagctccagtggcgggctgctctt

SEQ ID NO: 46433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagagttcatcatcagagggaatcccgaac

SEQ ID NO: 46434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatacgggggcaactaatgtcggagcct

SEQ ID NO: 46435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatatcggggaaacatgagaggcattgc

SEQ ID NO: 46436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatccttctgtttatttgaagggtagaa

SEQ ID NO: 46437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatcgaactaagaggtcaagattcggcc

SEQ ID NO: 46438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatcgattccggagtgactgggctatgg

SEQ ID NO: 46439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatctattcacgttgtctcttttgtgcg

SEQ ID NO: 46440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatctcgatttacggagtatgtcctatc

SEQ ID NO: 46441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatgtcgaagtctacgatgtctataggg

SEQ ID NO: 46442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatgtgcatgggccggggcgtttcggct

SEQ ID NO: 46443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagattggtgccctttctgtttttcgctcg

SEQ ID NO: 46444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagatttaacttgacgcgagtccacaggag

SEQ ID NO: 46445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcaaaattatgcagtagcgattcgttcg

SEQ ID NO: 46446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcaacattatgctccgctatataagctc

SEQ ID NO: 46447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcatatggcgggcggcgactgctgctgg

SEQ ID NO: 46448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcatctatcgaagggatagcttcgcgtg

SEQ ID NO: 46449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcatggggtaacgacgttccgtggggat

SEQ ID NO: 46450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagccacggccgaaaggtgagcgaccaagg

SEQ ID NO: 46451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagccagataagcaagctctaatccccacg

SEQ ID NO: 46452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagccataccatagtcgtctgcgggagtcg

SEQ ID NO: 46453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcgaggaggtaactgccgatgtggcacc

SEQ ID NO: 46454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcgatcgcacgaaagagacactcatctc

SEQ ID NO: 46455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagcgtcaccttccataaaccttcaatagg

SEQ ID NO: 46456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagctatcaagtgcgggaatacggttctgg

SEQ ID NO: 46457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagctcatggtcggatcctgaagttcggcg

SEQ ID NO: 46458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagctctgccatcagacgcatatcgctggg

SEQ ID NO: 46459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagctgaaaggtggttgaggagacactggc

SEQ ID NO: 46460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggatgttattcgcgctaggtacccgatt

SEQ ID NO: 46461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggcacgcaaatcccatagcccggtcggc

SEQ ID NO: 46462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggcacgcgagtaatccaccgagggcttt

SEQ ID NO: 46463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggcaggacaatattgttcgtgatcgtcc

SEQ ID NO: 46464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggcatagacgttcaactgaacgggggca

SEQ ID NO: 46465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggcgatgtggggcgtcgggtcggggcca

SEQ ID NO: 46466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggcgcagccgtgggtgtagcgaactcta

SEQ ID NO: 46467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggctacagtatgatgattgtctgggggg

SEQ ID NO: 46468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggctcgtggttcttcactctttgcgcgc

SEQ ID NO: 46469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggctgacgacgtctcatttgcaggatcg

SEQ ID NO: 46470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggaaatgcaaagagtttggttgctgcg

SEQ ID NO: 46471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggattggcttactactggctgctggcc

SEQ ID NO: 46472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggctctccgaggagtggacatggtagg

SEQ ID NO: 46473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggctggtacatgcatctctgtcttgtt

SEQ ID NO: 46474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggggagtatgcgcggaaattacggatcg

SEQ ID NO: 46475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggggcactcttgggccaatatgcggcta

SEQ ID NO: 46476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggggttactaaggggcactgtgcgtcc

SEQ ID NO: 46477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggggtacggaacttcctttaaggggtgg

SEQ ID NO: 46478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggtcaccgcagctttgtcgggtgtccg

SEQ ID NO: 46479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagggtctgaaatacagtctctgctgacta

SEQ ID NO: 46480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggtaggcgttactatgatgtcgacgtgt

SEQ ID NO: 46481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggtcacagtctcagtttaatcatctcgg

SEQ ID NO: 46482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggtgggtggggctcggattgcgttcgtt

SEQ ID NO: 46483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctaggttgtgatcgtttgttcactagttcgt

SEQ ID NO: 46484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtaaaacggactggtgtaccgacgtgcg

SEQ ID NO: 46485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtacgcttcgacttgcgctcagaagact

SEQ ID NO: 46486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtatcggtgtctcagtcttctggttgtt

SEQ ID NO: 46487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtatctagtcctttacaatatgatgtgg

SEQ ID NO: 46488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtatgtgcccggaggagaaagaggcagc

SEQ ID NO: 46489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtcaattgcatcttaagtgcgaggggta

SEQ ID NO: 46490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtcggcactggacctcgtttatgtggat

SEQ ID NO: 46491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgaccggctctattgactcggtcctcg

SEQ ID NO: 46492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgatcttgcgcaggcagggttagacgg

SEQ ID NO: 46493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgcgtcagtttcgtcttcaggtctgcg

SEQ ID NO: 46494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgctacccacgggagcgtacgggggaa

SEQ ID NO: 46495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgggagccgccaatcgtcatctgatgg

SEQ ID NO: 46496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgtcccaggtccacttacttcgtgcac

SEQ ID NO: 46497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtgtttcactgcggttgattggtggttg

SEQ ID NO: 46498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagttacctacgctactttcgcacggtgta

SEQ ID NO: 46499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagttctgattgtgtggtgtccattggtgg

SEQ ID NO: 46500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagttgattgcataagattgtgctttggtc

SEQ ID NO: 46501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtttcaacggtagaggggttctatccgg

SEQ ID NO: 46502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctagtttgcgtgcggagtttgtaaggtgctt

SEQ ID NO: 46503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctataagggtgaaggacgttcgacagttaaa

SEQ ID NO: 46504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatacaatcattttcagccttaggacgtgc

SEQ ID NO: 46505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatacattggccgttagcggcggcgtttgt

SEQ ID NO: 46506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatactgtataacccacgtcaggtccatac

SEQ ID NO: 46507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatagatcccgtgtatgcgatcggggttgc

SEQ ID NO: 46508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctataggacgttttcggtctaataccgcttg

SEQ ID NO: 46509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctataggatcacgttggctactcacatcggc

SEQ ID NO: 46510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatagggcgggacttgtcagttactcgcgc

SEQ ID NO: 46511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatatatcagctctaagggaattaaggtga

SEQ ID NO: 46512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatatcgggggctatcgttgtgctgttaag

SEQ ID NO: 46513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatatggactttgggtcataacaaggtttc

SEQ ID NO: 46514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatattatccggtgcactctagcacctggt

SEQ ID NO: 46515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcacaacgctcgtgcacgtgcaccatcg

SEQ ID NO: 46516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcatgctgcaggaagctctgctagctgt

SEQ ID NO: 46517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcatggcataaacactggttcgcgcgtg

SEQ ID NO: 46518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatccaaatgttggttcgttttagttgtct

SEQ ID NO: 46519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatccaatagaatcgtttccatggttcatt

SEQ ID NO: 46520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatccacttttcaggagtggtgactcaaag

SEQ ID NO: 46521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatccaggcaggcggatcgctgggtgctgg

SEQ ID NO: 46522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatccatttgacggtctcccctgcagctta

SEQ ID NO: 46523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcccgtctagttgcgagtacctcctggc

SEQ ID NO: 46524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcctagtgtccttaaatttcggttcggg

SEQ ID NO: 46525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatccttggcaggttgtggtgagggtatga

SEQ ID NO: 46526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcggcacgcaaccctgcgtcgtgatatg

SEQ ID NO: 46527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcggttcatcttcacgagcatgactatg

SEQ ID NO: 46528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcgtaaagcttgggtctccaccccgagt

SEQ ID NO: 46529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatcgtcaacggaacggttggccacgtatt

SEQ ID NO: 46530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgataccgattaatggatctcgctactt

SEQ ID NO: 46531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgatcgttgttaaggtatgcacgagtac

SEQ ID NO: 46532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgcaccaccacctgacaacgcggcagag

SEQ ID NO: 46533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgcatcccgcttgacacccattggaacg

SEQ ID NO: 46534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgcgcgatcatcttcgagtactgcgcgt

SEQ ID NO: 46535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatggatggcggatgtgccgtccgttcgtc

SEQ ID NO: 46536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatggcacctaggattcttattggagggac

SEQ ID NO: 46537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatggccgcacgttcgggttattttttggc

SEQ ID NO: 46538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgggctgcgtctcggtatggaagttgcc

SEQ ID NO: 46539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgggtttcgcacggaatggtctgacatg

SEQ ID NO: 46540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgtaaaacaattaggctccctctgggcg

SEQ ID NO: 46541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgtggaccgacacgttctacgataagcc

SEQ ID NO: 46542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatgtgtggacgatttcgtaactcatcaaa

SEQ ID NO: 46543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattacagactaccccgcctagcttgatcg

SEQ ID NO: 46544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattaggtctttacgtaattgtgtttacga

SEQ ID NO: 46545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattatctaacgtaacaagcgcgtttaaga

SEQ ID NO: 46546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattatggaccttagttttttcgtggtgcc

SEQ ID NO: 46547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattattgtactcagtgccggggccagatc

SEQ ID NO: 46548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattcaccatgtgcgttcccgagacgcaac

SEQ ID NO: 46549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattccgggcgttaaactaaggtctttcgt

SEQ ID NO: 46550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattcggctgtcacaggaatgggaccgggg

SEQ ID NO: 46551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattcgtcgagtgcgctggtctacgggaca

SEQ ID NO: 46552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatttatttatgaaattggatggttcaact

SEQ ID NO: 46553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctatttcacattagcgacaatagatgtgcct

SEQ ID NO: 46554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctattttcgtcaatactaacccccgtgacga

SEQ ID NO: 46555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaaaatcccgcgttttctaaaggctcatc

SEQ ID NO: 46556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaaaccgtagggcgcctcgacgtacgact

SEQ ID NO: 46557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaaacggggttcaggtgtccgacatgcgc

SEQ ID NO: 46558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaaacgtgtgtgtctctgattggtgcttc

SEQ ID NO: 46559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaacacattccgtagcgcgcgtgggtccg

SEQ ID NO: 46560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaacactatcgggtgactagggcccgcgg

SEQ ID NO: 46561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaaccctcaagaataggccgctgttctaa

SEQ ID NO: 46562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaacgactgccctttcgagccggtagcgc

SEQ ID NO: 46563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaacgagggtaatacgttgcagtaatccg

SEQ ID NO: 46564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaactacagacattgcactttcatcgatc

SEQ ID NO: 46565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaagagcagtacaaccataccggctcgtc

SEQ ID NO: 46566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaaggtatcgaggtgtgtgtggcatatgt

SEQ ID NO: 46567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaataacttcagaggaggtaacaagtgtt

SEQ ID NO: 46568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaatggcggagttccccgtctcttgcggc

SEQ ID NO: 46569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaattgctaataccgtatatgggacgagt

SEQ ID NO: 46570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacaacaacactacgtgcctgctttgggg

SEQ ID NO: 46571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacaatgtagtatcaacaaatcagtgtcg

SEQ ID NO: 46572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacacgctagtcagtgcatcggtgaaatg

SEQ ID NO: 46573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacacggcttatcgttccctagcttattg

SEQ ID NO: 46574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacactgacgcaagacgttatcgtggtcc

SEQ ID NO: 46575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacagcgaggcagttaggtacccgcgctc

SEQ ID NO: 46576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacagcgttcttcgtcatggcagtaaccc

SEQ ID NO: 46577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacatggcggtaccatacagctgtacatc

SEQ ID NO: 46578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaccaccacctcccgcatgcaggctgtcg

SEQ ID NO: 46579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaccagcttttcgtggtctgatggttacc

SEQ ID NO: 46580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaccagtgaactctctcccgttcttgttt

SEQ ID NO: 46581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaccgaaaccatggaaacacgctgtgacg

SEQ ID NO: 46582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaccgcgtccgccatcacataggtggggg

SEQ ID NO: 46583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaccgctttacgtgctgtgcgcatggttt

SEQ ID NO: 46584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacctatcgtgcgagggccctcgttgtgt

SEQ ID NO: 46585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacgatcttgacgcgcagggtataggggc

SEQ ID NO: 46586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacgcaaactcggttactacgtggtatgt

SEQ ID NO: 46587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacgcttaggcagttgcgtatatattgga

SEQ ID NO: 46588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacggcgggcaggcgtctcattatgtgcg

SEQ ID NO: 46589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacggtgacggaacgacctccaagaaccg

SEQ ID NO: 46590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacgtacggaagaggagggtatgttagca

SEQ ID NO: 46591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacgtgcatgtatattaatggagttattg

SEQ ID NO: 46592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcacgttccgcacgtactctctgatacgct

SEQ ID NO: 46593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcactggttgtggcagctttgctctagtgt

SEQ ID NO: 46594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagaatgttgtagccgcttctgtttctgc

SEQ ID NO: 46595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagattgtgccgatctgtggtcgctcgag

SEQ ID NO: 46596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagcaagactcgcgaggagtagtacttgc

SEQ ID NO: 46597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagcataataacgaaagcaagtcctcgcc

SEQ ID NO: 46598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagccaccacccgctcgttatcctagtaa

SEQ ID NO: 46599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagcggatcggtgtgttaaaaaaaactta

SEQ ID NO: 46600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagcgggaaagccttcgggaatgactgcg

SEQ ID NO: 46601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagctaggatgctggcctagccgtagctt

SEQ ID NO: 46602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagctcacaggtgacggggaatgttggtc

SEQ ID NO: 46603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagctccacgctgtctgctttgcagccga

SEQ ID NO: 46604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagctctgagatgaggcacgtcacctatg

SEQ ID NO: 46605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaggcgtcccctgtggtctttctggtgga

SEQ ID NO: 46606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaggggtgtgcttactgctcgctgttggg

SEQ ID NO: 46607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcaggtatgagtagattgggcagccggaac

SEQ ID NO: 46608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagtaatttggttgctataggggatcgca

SEQ ID NO: 46609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagtccagcgaggagcttggatgcggcac

SEQ ID NO: 46610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagtgtcgggtacacgcatgcttggctgt

SEQ ID NO: 46611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagttcgggcggcttaaaggttgaatccg

SEQ ID NO: 46612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagttctccatgggtagtgcgctttatgg

SEQ ID NO: 46613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcagtttgcctcgcggtttagccccaccct

SEQ ID NO: 46614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcataaggtgtggagtactctcttcagatg

SEQ ID NO: 46615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcatattatgccatgggatttgatacggtt

SEQ ID NO: 46616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcatcgtagccttcacatttcccaacgccc

SEQ ID NO: 46617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcatctcaatcatactctgaatccagcatc

SEQ ID NO: 46618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcatctttcagggtcatctggtcataacga

SEQ ID NO: 46619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcatgaattgaaaagccacgagcactcgct

SEQ ID NO: 46620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcattcggcaagccgcacatagtccgaccg

SEQ ID NO: 46621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcattgattccagtgaaagggtagcagcgg

SEQ ID NO: 46622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcattgtgggttctctacaagagcgtgtat

SEQ ID NO: 46623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcatttgtccctagcagcttccgtcggtcc

SEQ ID NO: 46624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccaagacgattcagggcggtcgcggtggg

SEQ ID NO: 46625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccaagcgtaatttgatttgaaagggcgcg

SEQ ID NO: 46626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccaccattggacccatacctgtcatgggg

SEQ ID NO: 46627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccaccgtttgcgggttgactcccatctaa

SEQ ID NO: 46628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccacgctttgatatgtatctcgttcagcc

SEQ ID NO: 46629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccacggcttcccctaccgcattcggggcg

SEQ ID NO: 46630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccacgggtctgttatgtcgtcagatctcg

SEQ ID NO: 46631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccactaaccccacggcgtcgtttgtggcg

SEQ ID NO: 46632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccactagggtgccaccgggactttgttgc

SEQ ID NO: 46633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccaggcgacatcttggcaccagatacctc

SEQ ID NO: 46634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccagtggtctggggatgttcggctctgga

SEQ ID NO: 46635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccataaaggaccgcgtcaacacagcgtgg

SEQ ID NO: 46636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatacccatatcacacagacagcaaggg

SEQ ID NO: 46637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatcacccttttgcattcgtttttacgc

SEQ ID NO: 46638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatcagtagagctgctcaccattggccg

SEQ ID NO: 46639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatcgctgggttctgggtccaagtcagg

SEQ ID NO: 46640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatctcgatacgataaaacgaaaggtgg

SEQ ID NO: 46641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatgcttgatcgttggtgtcgccacggg

SEQ ID NO: 46642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccatggtgggttctaaagctctggttaaa

SEQ ID NO: 46643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccaactatccatatcgcagtggcacgcg

SEQ ID NO: 46644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccagtcgcgtacgtatgggtcgcaaagg

SEQ ID NO: 46645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccagtgattggtggcagttcgcgacggt

SEQ ID NO: 46646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccccaaagctgatgaagcggtgctacgac

SEQ ID NO: 46647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccccacttacaccgttcgtagggcactgg

SEQ ID NO: 46648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccccctatttatggctctaaaagatctc

SEQ ID NO: 46649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccccggagctgagtattcggatgaggtgt

SEQ ID NO: 46650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccctctgatggcggcatgtaaggtagcg

SEQ ID NO: 46651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccccttgatccatgccctgacacttgagc

SEQ ID NO: 46652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccgatggtgtgtttgttgctcaggtagt

SEQ ID NO: 46653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccggaccacgcacagtgcggcacgttcc

SEQ ID NO: 46654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccggtagctagtagagcacgtgcctttg

SEQ ID NO: 46655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccgtgcgtagtcgatgacgggcaggaga

SEQ ID NO: 46656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcccgttctggtggtcttccgagcatcgta

SEQ ID NO: 46657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccctaggatacgtattcgtgtaagcacgt

SEQ ID NO: 46658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccctggtcgttgctcgcatctccgcaaca

SEQ ID NO: 46659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgaacagtaactcgggacgcgctttata

SEQ ID NO: 46660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgcaataatatagtacagcgtctgcgtc

SEQ ID NO: 46661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgcatatcgcaggggtgggcgttacagg

SEQ ID NO: 46662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgcgtgtaaatgctaaccttagtcgacg

SEQ ID NO: 46663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgggctttattacgcgaaacctcgcaac

SEQ ID NO: 46664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccggggagttattcctgtgttacaccttc

SEQ ID NO: 46665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccggtcttcggactacttcagcggtatgg

SEQ ID NO: 46666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccggttgtgttaattgtgatctggcagat

SEQ ID NO: 46667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgtaacgcagttttggattagcctaagc

SEQ ID NO: 46668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgtaactttggtgagatcgttgcttccg

SEQ ID NO: 46669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccgtttcctgttagggccgaccgctctat

SEQ ID NO: 46670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctaacatcttaaggttcccggccgatgt

SEQ ID NO: 46671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctacaggatgtgctcgtcgtccgggaac

SEQ ID NO: 46672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctacagtatgatccccaaccgtcttggc

SEQ ID NO: 46673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctcactcgatcgcaccgggcctgaccgt

SEQ ID NO: 46674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctcgagtatggggaagctgtcatggatt

SEQ ID NO: 46675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctcgtgtatctgcttgcgcgacgtctga

SEQ ID NO: 46676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctctgtagcagctttactcacgcgagtt

SEQ ID NO: 46677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctgaggtactacacaagcgcacgggcac

SEQ ID NO: 46678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctgcaagggtgaaggctttcctcggcca

SEQ ID NO: 46679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctgcagtggcgaactgcccattgttgcc

SEQ ID NO: 46680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctggagggaagttgcgcgccctaaccgt

SEQ ID NO: 46681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctgtcaccggtcgttcgcagacaactcg

SEQ ID NO: 46682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcctgttgggaagtgctggcggcctaggat

SEQ ID NO: 46683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctccttgaacatgtgcgcactcgtttggtca

SEQ ID NO: 46684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaaaccgcaaggcaaacaagccttggtt

SEQ ID NO: 46685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaacgacagtttcctccggtcgtcgacg

SEQ ID NO: 46686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaacgctgctcacgccactgtcgtcatg

SEQ ID NO: 46687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaacgtccagaaagcacgaagtcacggc

SEQ ID NO: 46688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaagttggtttatgtagaatagcttctt

SEQ ID NO: 46689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaatcgcgtctgacctctcattgttgat

SEQ ID NO: 46690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaattgtcctgtaacaatagaacgtccc

SEQ ID NO: 46691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgacgccagctatggacccttggattatg

SEQ ID NO: 46692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgactaaaccaacaagccggaaaccgggt

SEQ ID NO: 46693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgacttcgcgcgccggtctcctctcgggg

SEQ ID NO: 46694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgagaaacgttcgtctcttctgttagatg

SEQ ID NO: 46695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgagactgcactcattgctcccggaatca

SEQ ID NO: 46696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgagggagtttgacctaattaggattcac

SEQ ID NO: 46697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgaggttcagctcctgacagacttaagtc

SEQ ID NO: 46698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgagtcacggctcttcctgcacgctcgct

SEQ ID NO: 46699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgagtgactcgtttcggcaaaccaactcg

SEQ ID NO: 46700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgataccgacaaaacttgttaaccccgcg

SEQ ID NO: 46701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgatatctcagtcgggcatactccggaac

SEQ ID NO: 46702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgatcagggacgcacagggtgttaagtcg

SEQ ID NO: 46703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgatcattggccggtggagcattgcgggg

SEQ ID NO: 46704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgatcggcacggctggggattcgcctctt

SEQ ID NO: 46705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgatgatcggatactagttaggcaaggct

SEQ ID NO: 46706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgatggggggctgtctgttgcatcgattt

SEQ ID NO: 46707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcaactttggggctcttctcttgtggcg

SEQ ID NO: 46708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcaagcatctacactctcagctggccac

SEQ ID NO: 46709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcacatcccgagtcgccatcggccgggt

SEQ ID NO: 46710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcatgatggatattctgaactgtagatg

SEQ ID NO: 46711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcattgaccccggacgtcggtctgtacc

SEQ ID NO: 46712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgccacttggattttcattcttcagaagc

SEQ ID NO: 46713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgccatggttaatggtcgtcagaggtcac

SEQ ID NO: 46714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgccgactcggttcaagttgaggccgcgc

SEQ ID NO: 46715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgccgcggaggtacgaaatccgcctagtg

SEQ ID NO: 46716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgccgcttcttatcgcttggtacgctgga

SEQ ID NO: 46717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgccttactaggtaatgcttgagtgcgga

SEQ ID NO: 46718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgactctgcagcataaagactgttggt

SEQ ID NO: 46719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgcagacggcatcttacatttccagga

SEQ ID NO: 46720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgcccttcgcggctgttgtgtttttcg

SEQ ID NO: 46721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgcgtcactggccaatggttgctcaac

SEQ ID NO: 46722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcggccctttttggagcccaagtctgcc

SEQ ID NO: 46723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgggttgaaagccacttatgatgcggc

SEQ ID NO: 46724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgtgcggaggcaagtttgcggggactg

SEQ ID NO: 46725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgtgggcaatggcgttaaggcttcctc

SEQ ID NO: 46726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgcgtggttatcatatgttgaccgcaatc

SEQ ID NO: 46727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgctaatcctggttacttgagtgttatat

SEQ ID NO: 46728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgctacgactgacgggataacgggacgta

SEQ ID NO: 46729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgctagtctggcacttttcgggcaactcc

SEQ ID NO: 46730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgctcatgcttatccattttgctatcttg

SEQ ID NO: 46731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgctgcatcgttgattagatcagttaggg

SEQ ID NO: 46732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgctttatgttaagccgtctgcgctacga

SEQ ID NO: 46733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggaccgaaaattcgcgttgggaatgaat

SEQ ID NO: 46734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggacgtcttactcctcttgccagaggcg

SEQ ID NO: 46735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggagcacccgtgcaggctcaaggccata

SEQ ID NO: 46736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggagccgtatcaagtttcacttggggtg

SEQ ID NO: 46737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggagtaatatgatttgacaagcatgttc

SEQ ID NO: 46738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggatcggatcttacgcatagcatcactg

SEQ ID NO: 46739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggcacactgggcatttgcgggaacgaac

SEQ ID NO: 46740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggcagtaaatacacgttacggcctgcaa

SEQ ID NO: 46741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggccagcctatggaaatctaagggtagt

SEQ ID NO: 46742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggcgattcaagcgtcaaattgcacggag

SEQ ID NO: 46743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggcggtaacgttttgctggggccagcaa

SEQ ID NO: 46744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggcgtgtttcaaatccgtcagttgttta

SEQ ID NO: 46745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggctagcacgcaaggattgtatcggcgg

SEQ ID NO: 46746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggctggacattgtgtttgctgttccccg

SEQ ID NO: 46747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggctttggcagcaccggtggatcctgcg

SEQ ID NO: 46748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggacggtcaagcggtgagacatcgtcc

SEQ ID NO: 46749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggagttccatacatcggggatccgccg

SEQ ID NO: 46750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggcaaccgacatgccgattccatgtgg

SEQ ID NO: 46751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggccgttcagcttaggccgcttccttt

SEQ ID NO: 46752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggcgcggcattctacccgtggttcggt

SEQ ID NO: 46753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggctagcgatagagttttgctgtctcg

SEQ ID NO: 46754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggggaactagggaattgttgcgagtgtt

SEQ ID NO: 46755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggggaattggagcgaaaagggcgcttt

SEQ ID NO: 46756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggggtggggcagcaacacctcaactcc

SEQ ID NO: 46757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggggtgccactcatggaatgatcgaact

SEQ ID NO: 46758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggggttgggggtacagtaacgcaacgtg

SEQ ID NO: 46759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggtacatgctgtgtccgtcttgtggcc

SEQ ID NO: 46760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggtcgctctggccggcttgctagaacg

SEQ ID NO: 46761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggtcttctgcccggtaatgtagcgcgg

SEQ ID NO: 46762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggttagcgatagggcgtctttcatgct

SEQ ID NO: 46763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgggttggaaaaatgcgacttctggtgtc

SEQ ID NO: 46764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtacgtctttaaagaaacgagtacgat

SEQ ID NO: 46765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtagggcagtgatctgcttatcggtgg

SEQ ID NO: 46766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtaggttctttgggaacttgcagcatg

SEQ ID NO: 46767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtatgcgagtaggaaccacggtgggcg

SEQ ID NO: 46768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtcgaagttaggttctccatcggggct

SEQ ID NO: 46769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtctgcgtcccctggtgtacgttcgca

SEQ ID NO: 46770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtgctgaggatttctgtttggatagcg

SEQ ID NO: 46771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtgtatgtggcaactcgtcctggccgc

SEQ ID NO: 46772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggtgtgccgtctgcgactttgccacctt

SEQ ID NO: 46773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggttatggggtgaagagggtgttacggg

SEQ ID NO: 46774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggttcggttcactgcagcttgagttttc

SEQ ID NO: 46775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcggttgactatcatcctttcactctgcca

SEQ ID NO: 46776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtaaggtttgagttttccacccgtggtg

SEQ ID NO: 46777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtaccgtccgtgggggctgacgaaaacg

SEQ ID NO: 46778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtcaacacaatactctgttgcccgctac

SEQ ID NO: 46779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtccaccacgcgggataatgtgggccac

SEQ ID NO: 46780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtcccatcgtaccagggatgtaagaccg

SEQ ID NO: 46781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtcctcgcttattcggcatattctcatc

SEQ ID NO: 46782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtctagtgagtgctagtctgctatcgtg

SEQ ID NO: 46783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtcttctcgcggtttttgggtaccgtca

SEQ ID NO: 46784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtgcccgctggggtcaggttacgactgg

SEQ ID NO: 46785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtgcggacagcggcgtagtccaggcagc

SEQ ID NO: 46786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtgcgtgtaagaggcagtttgggcattg

SEQ ID NO: 46787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtggttttgagtctaacaatcgacagga

SEQ ID NO: 46788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtgtgctcaatacactcttcccgcctgt

SEQ ID NO: 46789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgttcatgcatctatgagagctgggccgc

SEQ ID NO: 46790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgttgctgcttacggttatagggctccgc

SEQ ID NO: 46791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgttggagagagactgcattacgtggcgt

SEQ ID NO: 46792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgttggccagcgatatgatacgggtgtgc

SEQ ID NO: 46793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgttgggttacttgggaccctctggaggt

SEQ ID NO: 46794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgttgtctaggtctgcgttaatgcaatgc

SEQ ID NO: 46795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcgtttactttatctgtcgggcaagtccac

SEQ ID NO: 46796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctaagaactccgtgctatcatgacagctt

SEQ ID NO: 46797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctaagtggcactgtgttagcggtaggatt

SEQ ID NO: 46798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctaattctcagtctcgataccggctttgc

SEQ ID NO: 46799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctacttgactggtgatgtcctgcacgttc

SEQ ID NO: 46800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctagtacgcggatggactgggtctccggg

SEQ ID NO: 46801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctataggcttccagtgttgttgcacgcca

SEQ ID NO: 46802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctatggaacatttgtagcaatgcgtgctg

SEQ ID NO: 46803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctatggcgcaaattcggttgctcgggacc

SEQ ID NO: 46804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcaacacccgggccggtcactgcgcctc

SEQ ID NO: 46805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcaacacttggaacttctccatttagtt

SEQ ID NO: 46806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcaagacagccgcgatatcggggcctgt

SEQ ID NO: 46807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcagtacttttccggacttagcgtttat

SEQ ID NO: 46808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctccacgctgaaagttctggcacgctgca

SEQ ID NO: 46809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctccccggcaagcctctctttcgatggga

SEQ ID NO: 46810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcctagcttctgatggccatgcacagta

SEQ ID NO: 46811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcggaatcgggcgtagggacgggaggga

SEQ ID NO: 46812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcgtacctgggtagactcgtgctgattt

SEQ ID NO: 46813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcgtactatttgtgggggtatgggttgg

SEQ ID NO: 46814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctctacggttagtaagaggatgtatcatg

SEQ ID NO: 46815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctctaggccattgaggcccagggtaaacc

SEQ ID NO: 46816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctctcggcgttcacgggcatttcgttcca

SEQ ID NO: 46817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcttatgcgggatggttgctgggctcgt

SEQ ID NO: 46818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcttatggcgcgctcaatcaatacggtg

SEQ ID NO: 46819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctcttgcgcaattctccgacgttcttgcc

SEQ ID NO: 46820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgagctacattagatctcgattccaatg

SEQ ID NO: 46821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgatgcgtctaggggcttgtctcgagcg

SEQ ID NO: 46822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgattaacctgtggctaggacgtaggcc

SEQ ID NO: 46823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctggggaggcgatgttagaaaacgaactc

SEQ ID NO: 46824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctggggtcgtaccttgatggcacctctgc

SEQ ID NO: 46825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgggtgtgtattattgaattgatacgga

SEQ ID NO: 46826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctggtagcgacatatgttatcagttgggc

SEQ ID NO: 46827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctggtgatcaggttagtattcccaccacg

SEQ ID NO: 46828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgtcagattattgccttattgcggaggg

SEQ ID NO: 46829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgtgcagctcagtcgggctacccttccg

SEQ ID NO: 46830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgtgggttttctgcattattgatattcg

SEQ ID NO: 46831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgtgtaggccacaggcgtatctcatgag

SEQ ID NO: 46832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgttaatgcgttgttacaccccgtccgg

SEQ ID NO: 46833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctgttcgcacggtgttgcggtacccatcc

SEQ ID NO: 46834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttattttgtataggatgttgtagggttc

SEQ ID NO: 46835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttcaacgatcacaggccatttctcgcct

SEQ ID NO: 46836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttcagtgataaacaggaaagtgttcgga

SEQ ID NO: 46837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttcgaatcacccacactgtatttgttgg

SEQ ID NO: 46838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttcgacacctgggaatgcgtaatattat

SEQ ID NO: 46839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttgccagatcgggtgaagtcgttcgtgg

SEQ ID NO: 46840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttgctatctgtaccagggagcggttgcg

SEQ ID NO: 46841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctttattctccccgtttactacgccatgt

SEQ ID NO: 46842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctctttctgaacgtgtatgccctgaccgtcg

SEQ ID NO: 46843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctcttttgcctgtctgttgcccaaagcacga

SEQ ID NO: 46844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaaaatggtggataaccacggtcgtttag

SEQ ID NO: 46845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaaaggtatgaggctagggataactgggg

SEQ ID NO: 46846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaaatgcccgtccaggtgcgcaatcgctg

SEQ ID NO: 46847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaaccaggtcccctctcttctcgttgctc

SEQ ID NO: 46848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaacgatgatgaagcggagtcagccggac

SEQ ID NO: 46849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaacgtgaggactggtgagtgtggaggtg

SEQ ID NO: 46850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaagaacactaggatgggttgcgcaggtc

SEQ ID NO: 46851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaagcgagacaatttaatggggagtcgcg

SEQ ID NO: 46852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaaggaaactttgtaccacatcattacga

SEQ ID NO: 46853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaaggttcatcgcataaaagtgaggggtt

SEQ ID NO: 46854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaagtgactacattgccggacctattaca

SEQ ID NO: 46855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaatcccggccgatgaatccggaagtgcg

SEQ ID NO: 46856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacaattctaagatgtcgtttcgccggcg

SEQ ID NO: 46857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacaccgccctgagacacttttgtagccg

SEQ ID NO: 46858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacagaagactcagtctatatagcgctcg

SEQ ID NO: 46859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacagaagcagtcggtccgtttctcttgc

SEQ ID NO: 46860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacagcactaaaacatgctagacgacatc

SEQ ID NO: 46861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacgactgagttcccgcttactgaggtgt

SEQ ID NO: 46862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacgatgttttgctgtctcatgcaatatc

SEQ ID NO: 46863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacgggtaaacgagcaccagacttacgtg

SEQ ID NO: 46864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgacttaagacagtcgatttgatgtgcggg

SEQ ID NO: 46865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgactttggtacttggccttgttttgcgag

SEQ ID NO: 46866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagacatggcacgcccaggtggaattatt

SEQ ID NO: 46867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagcacggatcgttagacccgggaggcta

SEQ ID NO: 46868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagcgtcaatgacccctactgacaactgc

SEQ ID NO: 46869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagctgaatcttgacgattggtttcacct

SEQ ID NO: 46870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaggaggtgtaaatgtcaccgtctcttct

SEQ ID NO: 46871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaggcaaagcgagccggcgtggagtgcgt

SEQ ID NO: 46872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagggcaacttgcggtgctacagacggtg

SEQ ID NO: 46873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagggtgaaatgggacggttgtttcgatg

SEQ ID NO: 46874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagggttacggcgactctcatctgactgg

SEQ ID NO: 46875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaggtcaacacgtggctgtgccagtctga

SEQ ID NO: 46876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgaggtcataacagaattacggtttctatt

SEQ ID NO: 46877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagtgataacttcaccggttttgtttcta

SEQ ID NO: 46878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgagtgctaccctttcatttgctgccagcg

SEQ ID NO: 46879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatagatattgaccgaggcttaacatcta

SEQ ID NO: 46880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatatcggggcaaaacattttagttcctc

SEQ ID NO: 46881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatcactaggcactatactacggggccgc

SEQ ID NO: 46882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatcagcagttttacatcatggttcgagg

SEQ ID NO: 46883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatccaggccgcgtgccccatgaaggtcc

SEQ ID NO: 46884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatccggtccctctcacgcgtggacattg

SEQ ID NO: 46885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatctaactggtttgacaaagcgtgggct

SEQ ID NO: 46886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatgagcggcacgccgttccgaacagaac

SEQ ID NO: 46887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatgctctgtgttgtcggcgtaaacaggg

SEQ ID NO: 46888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatggctcgtccatgggccaatcccacgt

SEQ ID NO: 46889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgattcggcatgacctaaggtgcgctttcg

SEQ ID NO: 46890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgattggtacttaccgacttcggaatccac

SEQ ID NO: 46891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatttcccatctctgttactttcggtata

SEQ ID NO: 46892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgatttgtaaaagccaattcactatgtagt

SEQ ID NO: 46893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaaaccgacattggcgaccggtcgcgta

SEQ ID NO: 46894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaaactctggctggtctaaggtggctcg

SEQ ID NO: 46895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaaattcagttagccttgcccgagggat

SEQ ID NO: 46896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaacatggcgggcagaggtcgagtcagg

SEQ ID NO: 46897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaagagggtacgcgattatggggtagtg

SEQ ID NO: 46898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaagggttcggccgttcgggggcagtga

SEQ ID NO: 46899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaagtgtgactcacctagggatggtcgg

SEQ ID NO: 46900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaatactgtcagaaagagaacgttcctt

SEQ ID NO: 46901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaatcagagcatgtacttcttctggtcc

SEQ ID NO: 46902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaatcatcgagctgtttttgtccgttat

SEQ ID NO: 46903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaatcgcaacaaccagactgtcgatcta

SEQ ID NO: 46904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaattactcgttaccagtcgccctggag

SEQ ID NO: 46905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacacgtacgaggcaccgtttagcggca

SEQ ID NO: 46906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacatggatgcgatgtgttaagctaggt

SEQ ID NO: 46907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacggagcggttggggagcgcggtacga

SEQ ID NO: 46908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacggtaccgtttgtgttacaccgacgc

SEQ ID NO: 46909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacgtttcccggacagtcgtattcgcgg

SEQ ID NO: 46910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcactcgaggtatggatgggggccgtaaa

SEQ ID NO: 46911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacttccatacatcatctaaaacattta

SEQ ID NO: 46912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcacttcgctgaatgaagggataactgtc

SEQ ID NO: 46913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcagacgacggttgaccttcctggtggga

SEQ ID NO: 46914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaggaaaaggtagcgatccgtatgccaa

SEQ ID NO: 46915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcaggagagggcaatacaggtctggaacg

SEQ ID NO: 46916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcagggtgcttgaatcacagtgtcggagc

SEQ ID NO: 46917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcagtataaggtctgagaggtctgtgtct

SEQ ID NO: 46918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcagtccgccttgcccgtcaggtatactg

SEQ ID NO: 46919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcatatgctcacctcgtttgcccataagg

SEQ ID NO: 46920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcatcgtgggacatgttgtgtcggcttgt

SEQ ID NO: 46921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcatgatcgactgtgtttccctcatctgt

SEQ ID NO: 46922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcatgcgatgaacacagaacccgccggcg

SEQ ID NO: 46923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcatggttgaggcgtaagtcaaagtgacg

SEQ ID NO: 46924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcattcgtagtcgcctatgggggcaactc

SEQ ID NO: 46925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcatttagcgacacaggtatgtgcacgtg

SEQ ID NO: 46926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccaactcggaagaatctgctgtcgtggc

SEQ ID NO: 46927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccaagctgcggttctagtctgaacggat

SEQ ID NO: 46928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccacaaaggcgagactgtttcctgcgac

SEQ ID NO: 46929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccacgaaaagagcttgtgggctagacga

SEQ ID NO: 46930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccacgtccgtccgctggaatttagggta

SEQ ID NO: 46931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccactatgtacttgcactctccgcgctg

SEQ ID NO: 46932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccagaacatgttacggtttagccgcggg

SEQ ID NO: 46933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccatccccaggcggttatcagtgcaggc

SEQ ID NO: 46934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccatgccaactggagaggattaatgttc

SEQ ID NO: 46935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccatgttgtgactttcagttaggtctcg

SEQ ID NO: 46936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcccaaataagcccgcgcgtactggttgg

SEQ ID NO: 46937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcccaggagtttgtggggcgcacccgttt

SEQ ID NO: 46938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcccagtgttgatgcccgtggaagtccca

SEQ ID NO: 46939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcccccgaatgtcggcgtcggtgagcagg

SEQ ID NO: 46940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccccgctgggattcagggagctgaggga

SEQ ID NO: 46941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcccggaaagacacattgcgaaactcgtg

SEQ ID NO: 46942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccctacacccgtcactctgcttccgggg

SEQ ID NO: 46943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccctccacttagatccttctctgagtag

SEQ ID NO: 46944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccctgcctgatgatcacatgtcgttagt

SEQ ID NO: 46945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccctggtcaccgtcagatgtcttgagtg

SEQ ID NO: 46946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcccttgtagggggatctgccagagctcc

SEQ ID NO: 46947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccgaagtcaactattattctgctatcta

SEQ ID NO: 46948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccggatgcgggacacgaggtgactcgag

SEQ ID NO: 46949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccggggggtgctaggtccgctttcacgg

SEQ ID NO: 46950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgccgtttactatcctggaagtatgatggc

SEQ ID NO: 46951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcctgggtcacacaacattggcctctgtt

SEQ ID NO: 46952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcctgtctttgaactgtcacgtccaagta

SEQ ID NO: 46953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgaatctttggtggcgagtgacctgcgc

SEQ ID NO: 46954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgacacgtgccgtcacgccatgttaacg

SEQ ID NO: 46955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgacacttatcttctgcagcgctgactt

SEQ ID NO: 46956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgacgaccacagagtgtttaccgcaccg

SEQ ID NO: 46957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgacgataaagcttcttaccgcggaagg

SEQ ID NO: 46958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgacgattcactggatgccgttaatact

SEQ ID NO: 46959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgacttgcgtcttgacagtcacttcttc

SEQ ID NO: 46960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgagtggcctcctagatcgcggcaatac

SEQ ID NO: 46961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgatcaccgtaggaagccacacttggcg

SEQ ID NO: 46962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgcaagaagtaatgaggattgcgtgttg

SEQ ID NO: 46963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgcacgaggaccggccccctttaaaggc

SEQ ID NO: 46964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgcgacgctttagctcaatccctgactc

SEQ ID NO: 46965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgctcgaaccttcacaggcgtgcggaat

SEQ ID NO: 46966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggacacccagtgtgcttctctagtgag

SEQ ID NO: 46967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggacactaaagtctcagagctgggggg

SEQ ID NO: 46968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggacagattagagttgctgctgcattg

SEQ ID NO: 46969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggagaaaaggacatctcccacagtgac

SEQ ID NO: 46970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggatgttcacacgatggaggttcggtt

SEQ ID NO: 46971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggcaaaatcaagtagatctgcaagtgc

SEQ ID NO: 46972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggcaaagggcaccccgtatcactgggg

SEQ ID NO: 46973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggccggggttcagttgggcggttttgt

SEQ ID NO: 46974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggtcggaattgtcgtattaaatccggt

SEQ ID NO: 46975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcggttaccctcgtctcactaatgatcgt

SEQ ID NO: 46976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtaaacctgacggccccgaccggtcgt

SEQ ID NO: 46977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtagttcaaggtctccagtcgttcacg

SEQ ID NO: 46978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtcaacagaccgaggcgcgatcgtgct

SEQ ID NO: 46979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtgctctactcccagtgcaagacgtca

SEQ ID NO: 46980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtgctttaccgattccagaatgtcagg

SEQ ID NO: 46981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtgtgcggcccaatcatacacgagtgg

SEQ ID NO: 46982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgttacacattagtttgatttggagccc

SEQ ID NO: 46983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcgtttgagtcatggaggagagcccgggc

SEQ ID NO: 46984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctaaacggtaactggtagtatcggttgt

SEQ ID NO: 46985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctaaggcgttcttcggtggttgccgatt

SEQ ID NO: 46986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctacaagcgcgcattctctcggacttgt

SEQ ID NO: 46987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctacaccgggacggcctatagattttgt

SEQ ID NO: 46988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctacctatcacctctgataacgtggtct

SEQ ID NO: 46989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctatctgcttccgctcgtgcggtatctg

SEQ ID NO: 46990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctatggctgttcaagggtacgggacgcc

SEQ ID NO: 46991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctcacgtcaagagttctcatttgtcgca

SEQ ID NO: 46992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctccgatgtcagcgttctgctggtaatg

SEQ ID NO: 46993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctcgaacagggcctaatattgcaacctc

SEQ ID NO: 46994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctcgcgtgttgtaaagtttaaccatggg

SEQ ID NO: 46995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctcgcttatctgcgaatattgaggtcga

SEQ ID NO: 46996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctctactcgctgttcctgggtgatgacc

SEQ ID NO: 46997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctgaagttggtgcaaccgacgaccagaa

SEQ ID NO: 46998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctgacggtcggtatcaggcgcctcctga

SEQ ID NO: 46999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctgagatgtctgaccactaatctagggc

SEQ ID NO: 47000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctgcaaataaatcaaaccttttagagcg

SEQ ID NO: 47001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctgcaagtcgcgtggcaccgatatggga

SEQ ID NO: 47002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctgctatgtagctcgtttcccctttaat

SEQ ID NO: 47003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgctggcaccgttcggggatgatcgttgga

SEQ ID NO: 47004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgcttgcgagtgggatgggatcattctgcg

SEQ ID NO: 47005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaaaataaaagttaaggatgcggtagtt

SEQ ID NO: 47006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaaagcgtactgtccagtcgtttatgtg

SEQ ID NO: 47007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaactgcaatgtacagatcgtcctctcg

SEQ ID NO: 47008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaagggtaccgcagaattagagacgcgc

SEQ ID NO: 47009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaagtcccgcttatctcacaccagcgtc

SEQ ID NO: 47010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaagtctgacactcgagacaacatggct

SEQ ID NO: 47011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaatcgactctgtgaccagtgctgctct

SEQ ID NO: 47012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaccaaccggaagttccacacgctgtac

SEQ ID NO: 47013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaccgtcttgcgcaagatcaccgggtca

SEQ ID NO: 47014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacctcagcaatctcccgccatgctggt

SEQ ID NO: 47015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacgaggttggggtactagtgaaggcgt

SEQ ID NO: 47016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacggaaggtttgatcgccccttagggg

SEQ ID NO: 47017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacggcacttaaaggtaggcgggcggga

SEQ ID NO: 47018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacggtggctacgaggaactgagtcagt

SEQ ID NO: 47019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacgtcggacggtcatggtccgttttgt

SEQ ID NO: 47020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggacgtgcaattgcgtttacctcatatga

SEQ ID NO: 47021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggactgcttttccgtcgtagtgcgaggtt

SEQ ID NO: 47022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggactggtttttgattgtgttgttgttaa

SEQ ID NO: 47023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggagacaattcttggtagccggctactgg

SEQ ID NO: 47024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggagacgtgctgattcggtcgtaaagtgt

SEQ ID NO: 47025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggagattacctaaactccgtgacgtttag

SEQ ID NO: 47026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggaggcattcgggctactgttgcgtgata

SEQ ID NO: 47027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatatggatatagtaagatacgatttat

SEQ ID NO: 47028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatcaggggcactcctacgcgatggtcc

SEQ ID NO: 47029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatcattacggtatgaaaacgtattgtt

SEQ ID NO: 47030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatcctggtccatggcaggtgagtttgg

SEQ ID NO: 47031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatcggttgagggaatctccctgctcca

SEQ ID NO: 47032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatgagccgcgcacagagccatccaaag

SEQ ID NO: 47033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatgccactgccgctgttccatattata

SEQ ID NO: 47034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatgggctggcttccggggaagtttcgt

SEQ ID NO: 47035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggattagattgtgcacttcctcgcaacgt

SEQ ID NO: 47036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggattagcaatatcctccaaacaggttgc

SEQ ID NO: 47037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggatttgttgttttgctctgttcgtacgc

SEQ ID NO: 47038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcaaacctgggcgtatatagcgggttaa

SEQ ID NO: 47039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcaataccctgtctgactccaacttgac

SEQ ID NO: 47040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcactcctggctacaaaatgggtgggtg

SEQ ID NO: 47041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcagatcgttggtgatctcgcacgcgac

SEQ ID NO: 47042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcaggagttgacggttcacgcgtatcgg

SEQ ID NO: 47043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcatctctagacatgctaaaccgtggcg

SEQ ID NO: 47044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcatgaccggtaacgggttgacacagtt

SEQ ID NO: 47045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcattatggggccggtgaagttttttga

SEQ ID NO: 47046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggccaatttgggaacttgcttggtattcc

SEQ ID NO: 47047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggccagggaggtcgagtgtggaggctagc

SEQ ID NO: 47048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcccaaaggcattagcttcaatgcggcc

SEQ ID NO: 47049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggccccaccaacggttctcccggctcact

SEQ ID NO: 47050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcccttgtttcctacaactagtagacaa

SEQ ID NO: 47051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggccgcaggcgatcacaacgcgctcccgg

SEQ ID NO: 47052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggccgggagacctggtagcggctttgggg

SEQ ID NO: 47053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggccgggcttcaacatcttgtgcgttcgt

SEQ ID NO: 47054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcctgtttacgggaacgatctgccacga

SEQ ID NO: 47055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcgagggcggaaatggggcgcaaatgcg

SEQ ID NO: 47056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcgataggcacggatcaatgttcgctac

SEQ ID NO: 47057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcggcactcagtgatcggattatattct

SEQ ID NO: 47058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcggcagtaagctttacaaggtaggcgc

SEQ ID NO: 47059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcggtagtggcacctcccatactttatt

SEQ ID NO: 47060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcggtgctgcatgttacatctttggact

SEQ ID NO: 47061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcggtgttgtacgatcatttggctctta

SEQ ID NO: 47062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcgtcatcatcgatttttaccatagctc

SEQ ID NO: 47063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcgtcttctctctgtcccgttgcgattt

SEQ ID NO: 47064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcgttttatcgcttacaaagcgtgaagg

SEQ ID NO: 47065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggctcaaaacacctgggatgcacctcgcg

SEQ ID NO: 47066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggctgaccgcaaaacaggacgcccgtgac

SEQ ID NO: 47067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggctgggcctgaatctgctgtcttttgtc

SEQ ID NO: 47068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggctgtcctgtcgtcgggtaccactacat

SEQ ID NO: 47069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggctgtgtgacgcttccaaggatgatgtg

SEQ ID NO: 47070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggctttacaggtaccgatggctgagtaat

SEQ ID NO: 47071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggcttttacatgtggtgtgcgcagtatat

SEQ ID NO: 47072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggacgagatggcactgaagacggagtgc

SEQ ID NO: 47073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggactgggatcgtagcggtgagaggcgc

SEQ ID NO: 47074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggagtggggttagcgtggtggccttctg

SEQ ID NO: 47075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggatagcctctcgaatagtatgaacccg

SEQ ID NO: 47076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggatatctgcatcattcaggcagagtct

SEQ ID NO: 47077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggattgggcctttgacatcggacggagc

SEQ ID NO: 47078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggccacgcgcgtttgagtgaaacacggg

SEQ ID NO: 47079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggccaggtagcgggtgtccaaacgtgca

SEQ ID NO: 47080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggccgctaagatcagatccatgcccgca

SEQ ID NO: 47081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggcgaacttttgagtacggagtttatcc

SEQ ID NO: 47082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggcgcggggtcatcggtgtagcgacgaa

SEQ ID NO: 47083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggcggtggaggaacttacgatcttgtcg

SEQ ID NO: 47084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggctcggaacttttcgtgacttaaacat

SEQ ID NO: 47085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggctgacacgattggggtcttggattac

SEQ ID NO: 47086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggggaagacgagcgagagcatgatcggtg

SEQ ID NO: 47087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggggacggcatgctcgcgtaggcactgca

SEQ ID NO: 47088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggggagtatgtgagtcggagatagtgcct

SEQ ID NO: 47089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggggatcagtgactgcttctagtgtgttt

SEQ ID NO: 47090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggggatcgacgtgcctgttcaccagttcg

SEQ ID NO: 47091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggggaatactttttcgggtttggaaaac

SEQ ID NO: 47092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggggcttcgttttcgcaacatgcacgtt

SEQ ID NO: 47093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggggggagtagcgagcttcgcttagacg

SEQ ID NO: 47094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtatcatttctttgccccaaacgtcat

SEQ ID NO: 47095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtatgacggtatggcacgatcgctttc

SEQ ID NO: 47096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtatggatgtgattaccagcttggctc

SEQ ID NO: 47097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtcgctagcacccattttaaaatcagc

SEQ ID NO: 47098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtcgtgagaattgcctggtttccccca

SEQ ID NO: 47099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtcttgttcaccaattgaactggcttg

SEQ ID NO: 47100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtgcaacaaccttatcgggctaggctt

SEQ ID NO: 47101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtgcactccttccattactgtatgggc

SEQ ID NO: 47102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggtgtgggatgttgtgcaagaccagtcg

SEQ ID NO: 47103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgggttgagcggagttgtcggcgagtttcg

SEQ ID NO: 47104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtaccccacgctggtctctggtgtgtct

SEQ ID NO: 47105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtacgtcatcgtcgctcttcacggccgt

SEQ ID NO: 47106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtacgttacatgtctacacatggcccac

SEQ ID NO: 47107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtatcagtctggcctcttatggtgttac

SEQ ID NO: 47108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtatcctatgtcgtttaggttattcgtt

SEQ ID NO: 47109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtatggactccgagcagctttaaccggt

SEQ ID NO: 47110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtccattcctcgtacatataatgcgtgg

SEQ ID NO: 47111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtcccaagcggctaagttacggtctgga

SEQ ID NO: 47112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtccccggtaataggccggagggtgttg

SEQ ID NO: 47113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtcggtgccgtagtgtggcatgatgaac

SEQ ID NO: 47114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtctgcggtccgtgctccgcctgtgttt

SEQ ID NO: 47115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgaacaccagtcgatattgtgccagag

SEQ ID NO: 47116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgagacaggcgtgactccgactcttgc

SEQ ID NO: 47117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgagcggtaccagttattgctcacatt

SEQ ID NO: 47118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgcttgcatcacagattcaggttggag

SEQ ID NO: 47119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtggctaggacatcaaagccggtacccg

SEQ ID NO: 47120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgggagacggagatgcctactccatgc

SEQ ID NO: 47121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgggtgaactttgcgggcgtggggggc

SEQ ID NO: 47122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtgtcgccgcaactgttttggtggatcc

SEQ ID NO: 47123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggttacgaacgattcggtttctggtcgct

SEQ ID NO: 47124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggttgtgtcctcggctggattccactcgg

SEQ ID NO: 47125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtttaatcgtcagcgtttcctgtcgggt

SEQ ID NO: 47126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctggtttcatgctagagtatatggacgcgtc

SEQ ID NO: 47127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaaaaggccacagcgtgcacgtagtctt

SEQ ID NO: 47128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaaaccgttatgagccaagcacccttcc

SEQ ID NO: 47129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaacctcgtttacgggtcgggtcggcgc

SEQ ID NO: 47130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaatagtgtcttttctcttcgaaggctt

SEQ ID NO: 47131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtacacatcatgtgcggtgtgtttgcgac

SEQ ID NO: 47132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaccgcaaaatttgggttaatactacgg

SEQ ID NO: 47133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaccgcaaagttgggtcaatctgtgcca

SEQ ID NO: 47134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtacctggttgcggtgaccgtaaatcatc

SEQ ID NO: 47135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtacgtcggggaggtgactgttttaaggc

SEQ ID NO: 47136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtactagtacgaaattgtggcagcgtcgg

SEQ ID NO: 47137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtactgtacgtcggttctgagcccttgcc

SEQ ID NO: 47138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtacttataagttcggatgatgtatctca

SEQ ID NO: 47139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtagaagggtaatcggtacgctgtagtgg

SEQ ID NO: 47140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtagacatgcaggttaggcgcgggcgttt

SEQ ID NO: 47141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtagcggaagtccggaaacactgcgggtc

SEQ ID NO: 47142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaggcagcactaatgactcctggaccga

SEQ ID NO: 47143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtagggcttttcttgtagccttctgtacg

SEQ ID NO: 47144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaggggagtgaagcagcgcgcgtgttgc

SEQ ID NO: 47145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaggggtcatgctgaaggctagaatctc

SEQ ID NO: 47146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtaggtacgggtgcttgcaagttttactc

SEQ ID NO: 47147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtagtggaaggacacaggagcgctgtgac

SEQ ID NO: 47148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtagtgggcgaacagttatcctcagggtc

SEQ ID NO: 47149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtataaggacccgggttctgcggttgtca

SEQ ID NO: 47150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtatgcattcgcggccctggcggtggggg

SEQ ID NO: 47151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtatgcggctcggggctacctcttgcgtg

SEQ ID NO: 47152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtattcggtcaaggcatatctgttcttga

SEQ ID NO: 47153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcaaagcagttccacggttgggacggat

SEQ ID NO: 47154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcaagtgttcagaccaactcaattgcac

SEQ ID NO: 47155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcaataggcacacgtttgagaaacgcgt

SEQ ID NO: 47156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcacatcgaccggttgtcggttttaggg

SEQ ID NO: 47157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcactccatggcgtgggcgagcggctcc

SEQ ID NO: 47158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcactctctgcatccgccttccgtcggc

SEQ ID NO: 47159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcagtgcgctctacgcttacccgagttg

SEQ ID NO: 47160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcataaatgtgccgcttcactcagtttg

SEQ ID NO: 47161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcccttcgcgtttgatggtgcggcgtcc

SEQ ID NO: 47162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccgagttcgcatttctgatcgcttatg

SEQ ID NO: 47163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccgggggagactccggggcgtttaggc

SEQ ID NO: 47164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccgtcggatcgcgtcctacgaacacgt

SEQ ID NO: 47165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccgtgcacagatttgctgcagctaatc

SEQ ID NO: 47166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccgtgtcgtgcaatgcagcgtcgtggc

SEQ ID NO: 47167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcctattgtctaaaacgtgcgtgtcggg

SEQ ID NO: 47168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccttataaagtgtgcacctaattttgg

SEQ ID NO: 47169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtccttccctttcgtgtccacgggattat

SEQ ID NO: 47170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcgaacgcaccctcacgtctcgcacctg

SEQ ID NO: 47171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcgacgaggacgctgggttatctgccac

SEQ ID NO: 47172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtcgtcgtttccgccatataagtgcagta

SEQ ID NO: 47173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtctccctcatctcagcgcatatgtactt

SEQ ID NO: 47174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtctctgccagatcagattggcgtcacgc

SEQ ID NO: 47175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtctgtgcgggcaacataagagctctagc

SEQ ID NO: 47176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtctgttgatgtgggtgcccctcaccttt

SEQ ID NO: 47177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgacaagtccgagtctgtcggcggttcc

SEQ ID NO: 47178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgacagcaaagggacgagtcgtggatct

SEQ ID NO: 47179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgacctgggtccgcgattagtatctgca

SEQ ID NO: 47180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgatctcatgacctgctttccctcggta

SEQ ID NO: 47181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgccgggtacaagccgttgctctgggcg

SEQ ID NO: 47182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgcctcaacttagcagtctcaaggggcc

SEQ ID NO: 47183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgcgagttgttcacgatcttgggcggtc

SEQ ID NO: 47184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgcgtacagaggatcgccgtcgcttgga

SEQ ID NO: 47185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgctactcagttatgtagtttgagtacg

SEQ ID NO: 47186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgctcgtcgagggcaacattattgactg

SEQ ID NO: 47187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgctgcaagcatgagtgggttctttgtg

SEQ ID NO: 47188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggacacgaagtaaatgtagagctgctt

SEQ ID NO: 47189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggaccaccagaccgtacttggcacgca

SEQ ID NO: 47190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggcctaacgctaagattcgtctctcct

SEQ ID NO: 47191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggctgtagaggcaaatgtacgtctgct

SEQ ID NO: 47192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgggatgcagcaaaggctaaacatgtct

SEQ ID NO: 47193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgggcggttagcggttcaggacggggcc

SEQ ID NO: 47194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggggagcgttcacctgagcgttcagtc

SEQ ID NO: 47195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggtaaagtaggcagcctcatcgcatat

SEQ ID NO: 47196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggtctcggtcacggccggcgcagactg

SEQ ID NO: 47197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtggtgtgtttgttgggatagcttttgta

SEQ ID NO: 47198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgtacctttgacgggttatcattcggtt

SEQ ID NO: 47199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgtcgttcgggcttcacggatgcttcct

SEQ ID NO: 47200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgtgcgtatccgcgcgtccgtaccccac

SEQ ID NO: 47201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgtggctttaggcttacacgtaggctcc

SEQ ID NO: 47202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgtgtagtgcgtctgttctcgtccaatg

SEQ ID NO: 47203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgttagcgatagcgtgtacattgacgct

SEQ ID NO: 47204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgttgtatcagtacgtgccctgatggta

SEQ ID NO: 47205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtgttttttcgaatcgtactccccttaga

SEQ ID NO: 47206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttacccacccgcacgtggcatagctttg

SEQ ID NO: 47207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttaggtagaggcctccttgcggctcgtc

SEQ ID NO: 47208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttcaaagcgatccccacgcggcttggat

SEQ ID NO: 47209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttccaaaatacacctgtgtgtgtccgtg

SEQ ID NO: 47210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttgaacgggtaggtcggtcgcttcttag

SEQ ID NO: 47211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttgcagtgatcagggggcactaggagtc

SEQ ID NO: 47212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttgcgcgtgggaatgaatagcaaacctt

SEQ ID NO: 47213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttgggattcatacggtgcgtgatgatgg

SEQ ID NO: 47214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttggttttggccatatcgaaccttgggt

SEQ ID NO: 47215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttgtctataccaggcttaaacgtactcc

SEQ ID NO: 47216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttgttcgacacaatacaattgccgcggt

SEQ ID NO: 47217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtttaaaagatgctgttctcctccttaat

SEQ ID NO: 47218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtttaggtccactctcgcacacttctgtg

SEQ ID NO: 47219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtttcttgcgcataggggcggtgcatatc

SEQ ID NO: 47220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgtttgaactctgacttaagtttgtcacgt

SEQ ID NO: 47221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctgttttctaagctcgaggttgtcggtgcgg

SEQ ID NO: 47222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaaaacgatttacctctagtttttgcgcg

SEQ ID NO: 47223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaaacaggtttgcgttaaggttgttcaaa

SEQ ID NO: 47224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaacataatcgtctgtctggcacccccgg

SEQ ID NO: 47225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaacgtggaggccacggagatccccgtga

SEQ ID NO: 47226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaactcggcttccatgcaataatcgtcat

SEQ ID NO: 47227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaactgtggagtactaatatgtctaagca

SEQ ID NO: 47228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaagacatagtccttcgcagatcgatcct

SEQ ID NO: 47229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaatatgggtacggggtgtttggattaac

SEQ ID NO: 47230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacaggcgatcagtcagtatatggagttt

SEQ ID NO: 47231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacaggcgtgctacgaggggcattcttgc

SEQ ID NO: 47232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacataccgtaggcgtgataccaaacctt

SEQ ID NO: 47233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacatcgaagtgctagacgtgcggccgcg

SEQ ID NO: 47234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacattttgatagtatggaggacgtaaac

SEQ ID NO: 47235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaccatccggatgccgcttcctccccgcc

SEQ ID NO: 47236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaccctctctgcttctctttggcgttctg

SEQ ID NO: 47237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaccgggggcaatgtattttgcgtgtgtc

SEQ ID NO: 47238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacctatggtacgtagaatgcaacatgtc

SEQ ID NO: 47239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacctcgcattctggttacaattctttgg

SEQ ID NO: 47240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacggcctgaggtaggctcaatgcggcta

SEQ ID NO: 47241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttacgtgtaccattacttcttctctgaatt

SEQ ID NO: 47242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttactactttcaccatcttagctggaatga

SEQ ID NO: 47243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttactatgtgtactaggccgatcacaggtg

SEQ ID NO: 47244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttactcctaacgatagacccggggcaattg

SEQ ID NO: 47245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagaaagtgtcctggtgatgtggttctcg

SEQ ID NO: 47246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagatccgtacgaccctcattgctcgttg

SEQ ID NO: 47247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagccgggtcgacctaacagttagtatat

SEQ ID NO: 47248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagcggggttacgcaggctactagatact

SEQ ID NO: 47249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaggaattgcgcgatgcccataaggtgca

SEQ ID NO: 47250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaggatgagatctcacagtgcacgagggc

SEQ ID NO: 47251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagggaaatttccgagcgtcagactctac

SEQ ID NO: 47252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaggtcattgcgatctgcctgactgcggc

SEQ ID NO: 47253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttaggtgtgtagcctacatctgctgacttt

SEQ ID NO: 47254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagtagaggtcaatatgcactcctgcctt

SEQ ID NO: 47255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttagtcgcgtcagtctataggttactgata

SEQ ID NO: 47256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatcaattaatgtcgaggatacggtctgt

SEQ ID NO: 47257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatctatccaatgtccatgtcttattggc

SEQ ID NO: 47258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatctattttgaccggctccgcatgtctt

SEQ ID NO: 47259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatgaggaatctgaccacgtcatgccctt

SEQ ID NO: 47260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatgggagactggcggactgtccgtcgtg

SEQ ID NO: 47261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatgtgtattgattttggttcagtgttcg

SEQ ID NO: 47262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttattgcacgttatctcactgtaaggtagg

SEQ ID NO: 47263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttatttcgcgtgttagaatcatccaagcgg

SEQ ID NO: 47264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcaaactgaccgcacagctaacggccaac

SEQ ID NO: 47265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcaacggaattaatcagcgtgggtgtgga

SEQ ID NO: 47266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcaaggttaggacgttctcaccccactgc

SEQ ID NO: 47267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcacacttttaaatatgaccggggcgtct

SEQ ID NO: 47268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcaccgaagagaaggcctgcgttgtagag

SEQ ID NO: 47269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcactacccgttaacggatcagggattat

SEQ ID NO: 47270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcactggcctcatgtcgtctcgctcggcg

SEQ ID NO: 47271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcagacccaaagttcggcggctcgggttc

SEQ ID NO: 47272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcagatgatgtcaacgtaggtcgggaccg

SEQ ID NO: 47273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcagcagtacgattctccatcgccgggat

SEQ ID NO: 47274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcagcatctgattacgaccaaccgctgtc

SEQ ID NO: 47275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcagctcgtcttaatccgaccctcagcgc

SEQ ID NO: 47276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcagcttcgttgttgtcttgtgttacgag

SEQ ID NO: 47277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcaggaccggaggtaatggcgttcggtcg

SEQ ID NO: 47278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcatacaggtccccccgaagtgattttgt

SEQ ID NO: 47279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcatcttttgatgagttatccggttctac

SEQ ID NO: 47280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcatgatttgcagtccgcttgcgtgccgt

SEQ ID NO: 47281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccaagctcgataatcgagccttaacggt

SEQ ID NO: 47282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccatcttagtcggacgactttattcggt

SEQ ID NO: 47283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccatggcaggtgttgagcgtttgatcgg

SEQ ID NO: 47284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcccaccccggaactatttgcgtaaggga

SEQ ID NO: 47285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccccgttgcagactagtcgcgttcggcg

SEQ ID NO: 47286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcccggggatttagctgtgtacaacctgt

SEQ ID NO: 47287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccctcctgactttaactacgggatagca

SEQ ID NO: 47288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccggcaacaaacttaattccgggagcgg

SEQ ID NO: 47289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccggcaggggtgcacgtgtacgtcaact

SEQ ID NO: 47290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccggttactacctctcgttttgggcttc

SEQ ID NO: 47291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttccgttctcaccttcgcattcagcatctc

SEQ ID NO: 47292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcctatgaggtcgtcgcaatccctcgacg

SEQ ID NO: 47293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcctgaccttacaacgattacatctattc

SEQ ID NO: 47294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcctgatcgcctgcgtctgcacttgtggt

SEQ ID NO: 47295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcctgcagcaacatgccatgtatctcagc

SEQ ID NO: 47296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcctggtctacacttatttcaagatatat

SEQ ID NO: 47297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcctttgatgtttatgggttggtcgctgt

SEQ ID NO: 47298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgaattatttgcgtatagttctagggcg

SEQ ID NO: 47299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgaggaaggtgtattcgggttagtgtgg

SEQ ID NO: 47300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgagttgcgaggggaggctgctcatgtt

SEQ ID NO: 47301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgatggcggtggaaggctcaacattaga

SEQ ID NO: 47302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgatgtacccaaggaacacgggtgtgta

SEQ ID NO: 47303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgattatcgatagcggtatactagagcc

SEQ ID NO: 47304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgcaagagaccgtgggacgctcccgacc

SEQ ID NO: 47305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgcatctgagccaagtttattgtgcagg

SEQ ID NO: 47306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgcggtatgtgccgtccagcatatcccc

SEQ ID NO: 47307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgctaaagctccacttgccgtggtactc

SEQ ID NO: 47308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgctaggtgggactaactctaggctccg

SEQ ID NO: 47309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgctcgtttacgcacgtctccgcggtgg

SEQ ID NO: 47310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcggaacagcacactactggggctatgga

SEQ ID NO: 47311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcggacggcggaggaagtgatcaggaaat

SEQ ID NO: 47312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcggagtatctttgctgtctctgtgttta

SEQ ID NO: 47313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcggccgtccgacgcaaagcagcagcgca

SEQ ID NO: 47314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcggcgggcgatcacttcatctttttgtt

SEQ ID NO: 47315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcggtacgttctttgcgtccatggagcct

SEQ ID NO: 47316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcgtttggtttccttgcaggcaagatggt

SEQ ID NO: 47317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctaaacgcgcaaccttgatcccgctacg

SEQ ID NO: 47318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctatactgaatatctttaggcagtgcgc

SEQ ID NO: 47319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctattccaacgtttcttcctgatttgat

SEQ ID NO: 47320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctgcattcgacctatcaaatacaaacct

SEQ ID NO: 47321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctggcacatctggctacgttgcccgtga

SEQ ID NO: 47322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttcttgtttgtgggaatgcggggcgtgcgc

SEQ ID NO: 47323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctttcgctcacctgtgcctcgagggtta

SEQ ID NO: 47324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttctttgcccgtaatcccactgtggctcga

SEQ ID NO: 47325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgaaacctaaacacgatctttctcgggcc

SEQ ID NO: 47326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgaatatccaggcattcaactttgttgga

SEQ ID NO: 47327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgacaatgcgcccagcttggggaatctgg

SEQ ID NO: 47328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgacagactgctaactgctctgtgctacg

SEQ ID NO: 47329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgacaggtccgggcgctgtaaatttcctc

SEQ ID NO: 47330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgaccaaatacgctggacaacacgcgtga

SEQ ID NO: 47331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgacgcgaggatatgaccgctgtctctcc

SEQ ID NO: 47332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgactaccgccctgagcagttagtaacgt

SEQ ID NO: 47333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgactacgcgtctccgctcagttactgtg

SEQ ID NO: 47334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgagaccggtgttaatgaatttcttatgt

SEQ ID NO: 47335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgagaggtttaaactggccgtgtcttccg

SEQ ID NO: 47336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgagcagtatcttcaattgtgttcgtttg

SEQ ID NO: 47337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgagggagccttgcactggggtgtgagtg

SEQ ID NO: 47338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgaggtttaatgttcgcggatgattaatc

SEQ ID NO: 47339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgatgcacgttgggttgtcgccaagtgcg

SEQ ID NO: 47340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgatgtcactatgataacggccctgggca

SEQ ID NO: 47341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgattaatcgatgcgtctcgtggctgttc

SEQ ID NO: 47342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgattggtgtgacggagcgtacagacatg

SEQ ID NO: 47343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcaaacatctggcaacccgtgtgccata

SEQ ID NO: 47344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcaggcataatggttgcttcacatttgg

SEQ ID NO: 47345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcagttaatttggacatacgagtgtcta

SEQ ID NO: 47346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcagttacccacctatgtgagggcttct

SEQ ID NO: 47347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcatcgctcgctgggattttcctgatcg

SEQ ID NO: 47348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcatggccttgaaggcactcattgactg

SEQ ID NO: 47349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgccaagtctccgaagtagcgggttgcac

SEQ ID NO: 47350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcccggcgcccaacggctaaagcgctgt

SEQ ID NO: 47351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgccgtcgtgtgggcttaaactcccgcct

SEQ ID NO: 47352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgccgtgtgatgtgcacgcttctcattgg

SEQ ID NO: 47353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgccttgggtgcctcgttaacctccccgt

SEQ ID NO: 47354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcgatacagattagagcttgcggtcggc

SEQ ID NO: 47355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcgtaattccctaactttcggacactac

SEQ ID NO: 47356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcgtatgtaaacttagacagtccaatgc

SEQ ID NO: 47357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgctatttcatcagctttctattgcggcc

SEQ ID NO: 47358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgctggaccagaaatacatgtcgacacgg

SEQ ID NO: 47359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgctggcatacacactcggcaaggtttcg

SEQ ID NO: 47360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgcttgtatagagcaggaattactttagc

SEQ ID NO: 47361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggaacctcctccttatggtcatcgtgta

SEQ ID NO: 47362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggaagctgcgggaaaagggtgtgcttcg

SEQ ID NO: 47363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggaagtggtatgctcctctttctggtcc

SEQ ID NO: 47364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggacggcgtagcgagttcctctaagggt

SEQ ID NO: 47365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggaggtgtccctttggacggtttcgaga

SEQ ID NO: 47366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggattaagggggcgcgtctgaacctggg

SEQ ID NO: 47367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggatttgtaacgcaggacctggataaag

SEQ ID NO: 47368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggcaattttaaaccgaacccgacggctt

SEQ ID NO: 47369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggcagtgctactttgacctaggtgtccg

SEQ ID NO: 47370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggcatacgacaatacggcagtgctgcgg

SEQ ID NO: 47371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggcatttatcaatttcggcactgagatc

SEQ ID NO: 47372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggccaccgtaaccgcggcttggcgatga

SEQ ID NO: 47373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggccaggccactgtttttactacacctc

SEQ ID NO: 47374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggcgtaaacctaagggactctttgctcg

SEQ ID NO: 47375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggctcctcggtaatgatctcggccgtac

SEQ ID NO: 47376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggctgggtcatgcttgatgttcgcggct

SEQ ID NO: 47377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgggagcctcggtacgttaccattggctg

SEQ ID NO: 47378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgggaggtgggcctggtagtgtgggcctg

SEQ ID NO: 47379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgggggttacagcataggcttctgtacgt

SEQ ID NO: 47380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggggtaggaacacgtaaagtgggtgagt

SEQ ID NO: 47381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggggttggagcaacgtggttggcgtatc

SEQ ID NO: 47382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgggttatgtggtgacagctatcttcacg

SEQ ID NO: 47383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggtaactaagttagcttttgagattcgg

SEQ ID NO: 47384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggtcacttatagaccgaacgcgaacatg

SEQ ID NO: 47385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggtccacgggcctacattgatgccccaa

SEQ ID NO: 47386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggtgatcttaaaagcgtcgactgcctcc

SEQ ID NO: 47387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggttactttcgaatcatttgcaacgtcg

SEQ ID NO: 47388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggttagaattgacgggtggtgttgtagc

SEQ ID NO: 47389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggttcaacatgtgcttacgtaaagaggc

SEQ ID NO: 47390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggttcaagggctggtcattgaggcgatc

SEQ ID NO: 47391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttggttccacacccttttgcctttgatcgt

SEQ ID NO: 47392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtaataagcgttctttgttactattggt

SEQ ID NO: 47393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtaatacgccagctatgttcttctgttc

SEQ ID NO: 47394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtacgagcgcaaggcgggtaattacaag

SEQ ID NO: 47395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtatattccagcttttagttatgttcga

SEQ ID NO: 47396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtatccgggcaccggccatcctaggagt

SEQ ID NO: 47397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcacgcgggttatgcggtgtttggttg

SEQ ID NO: 47398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcatagggatctgttatgttatgtttg

SEQ ID NO: 47399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcatatacacttggggacggatacagg

SEQ ID NO: 47400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcatcgtggggcattggaatcccagca

SEQ ID NO: 47401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcatgattggagacgcaaggcggaacg

SEQ ID NO: 47402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtccttttttcctagtgaggagattaat

SEQ ID NO: 47403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcgtgattgagcattccgcagtgacgg

SEQ ID NO: 47404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtctaaggtagttacactcacgcacatt

SEQ ID NO: 47405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcttacactgctgtcgagggattgata

SEQ ID NO: 47406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtcttgcctaaaggagagacagtacgaa

SEQ ID NO: 47407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtgccgccgacctgtgatcgattttagt

SEQ ID NO: 47408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtgcgctgatttaaggcagcgggtggcg

SEQ ID NO: 47409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtggacgaggtgatcatccttttgcatc

SEQ ID NO: 47410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtgtcaggttctcataatctggtacgcc

SEQ ID NO: 47411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgttatcttaagtagtcaacatgacgctt

SEQ ID NO: 47412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtttgcgagcatctggactgctgtaccc

SEQ ID NO: 47413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgtttgtcgctgaagacgattctgctccg

SEQ ID NO: 47414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttgttttttacggttggaatagatcacagc

SEQ ID NO: 47415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaaaccattcctaaaaccactggggtat

SEQ ID NO: 47416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaaatgtgcggggtatgccacagtgcga

SEQ ID NO: 47417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaagtcgcgagctctcaaaacggcctca

SEQ ID NO: 47418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaatagtgtgtccgtaccctcgaggggt

SEQ ID NO: 47419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaatggggtgagttagggatcttagctg

SEQ ID NO: 47420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaatttgagtagaacgttgtggctctaa

SEQ ID NO: 47421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttacagtggcctgtctgcacctgatgtcc

SEQ ID NO: 47422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaccgttattgagaactgatctgacagg

SEQ ID NO: 47423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttacctattcctaacttcactatttttag

SEQ ID NO: 47424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttacgggtttgcagtcgctcgggacacca

SEQ ID NO: 47425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttactgcagtgaacgcgctccacgtctcg

SEQ ID NO: 47426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttagcctttaatgatgatatcccgagcgt

SEQ ID NO: 47427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttaggctatcataactcgtgcgggggcgc

SEQ ID NO: 47428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttatagaaagacgcagaggggcgcttgac

SEQ ID NO: 47429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttatcacggtgtttcgaataatcaagcgg

SEQ ID NO: 47430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcaaacatttggcgcgattatctcaggg

SEQ ID NO: 47431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcagaatccgcttattttggcactcgga

SEQ ID NO: 47432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcaggtggacatgcgatcaagcctcgcg

SEQ ID NO: 47433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttccaatctaggggacgacatcactccta

SEQ ID NO: 47434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttccacgcggtctcttcttagttcggtac

SEQ ID NO: 47435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttccaggtacgcgacaactgctatactgt

SEQ ID NO: 47436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcccgtttcctagccagactagctgttt

SEQ ID NO: 47437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttccgaggttttatctgttttctctatca

SEQ ID NO: 47438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttccgatagggtgttgctgctggtatctt

SEQ ID NO: 47439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcctgtgtggtggtgtccgcagaggctt

SEQ ID NO: 47440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcgatgttcggcatgctctcttgtaaag

SEQ ID NO: 47441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcgtgacgagcttccagtcgcagcgttt

SEQ ID NO: 47442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttctacgcaaataagattgtgctccgccc

SEQ ID NO: 47443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttcttggtcattaactacggttcatagac

SEQ ID NO: 47444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgaaggtggggttcttcatatcagatca

SEQ ID NO: 47445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgaggcgttcggtccgagaggagtgtcc

SEQ ID NO: 47446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgatcagtacaaaggattacggtgactt

SEQ ID NO: 47447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgcaagtttttacgggcggtgggcgctg

SEQ ID NO: 47448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgcagctcatacactctggggttgttgt

SEQ ID NO: 47449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgcaggctgcccaggcgtgactcttctt

SEQ ID NO: 47450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgcgggcaaacttaagcatcatcaggct

SEQ ID NO: 47451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggaagacatgtgtttgtggtcactgtt

SEQ ID NO: 47452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggagacacgcgcatgggtcgtttacgc

SEQ ID NO: 47453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggatccgtattatctggtttcatcttt

SEQ ID NO: 47454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggatgttaattggtagtgtttattgtc

SEQ ID NO: 47455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggcgctcaggcccgctcgaattcaagg

SEQ ID NO: 47456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgggacggcaactcccaatgtgtttttg

SEQ ID NO: 47457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgggacgggcgtacaaactcgttcaggg

SEQ ID NO: 47458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggggcaaatgatagatcgaactgcttg

SEQ ID NO: 47459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgggtggtcggccttcgctactgcatga

SEQ ID NO: 47460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggtaacatgtggcgatgtcctttccgc

SEQ ID NO: 47461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttggtcctctctatcgaccacagtacggg

SEQ ID NO: 47462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtaccgcaggggcattggtacctgttc

SEQ ID NO: 47463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtcctgggcggtacctgggacttgtag

SEQ ID NO: 47464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtctgactcctgggcggatctcgtgcg

SEQ ID NO: 47465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtcttgagcctgtgtggtactaacctc

SEQ ID NO: 47466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtgacgtagtacataccgcaagtaagg

SEQ ID NO: 47467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtgagactcataggatcgccatgggag

SEQ ID NO: 47468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgtggtatgaggttgttgggtcggtgcg

SEQ ID NO: 47469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttgttggcttgaatgatacactccgttgc

SEQ ID NO: 47470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttagcacacgagtaaggcgcgccgcgcg

SEQ ID NO: 47471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttagggggcttccagcggatggcggtcg

SEQ ID NO: 47472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttcttgacgcatctgggtttggtctagg

SEQ ID NO: 47473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttgcagttgtcagttttgtacctattag

SEQ ID NO: 47474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttgccggtggacatctcccacctgctcc

SEQ ID NO: 47475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttggcgttgatatcacccgctattttaa

SEQ ID NO: 47476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttgtaattgtgtcccactgcactttttc

SEQ ID NO: 47477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gctttttcgcaggaggttaatgggatctctgc

SEQ ID NO: 47478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gcttttttaaagaacgatatctcacaaggttg

SEQ ID NO: 47479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaaacgtgtacatgccagtgttgtgcacg

SEQ ID NO: 47480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaaagattatggcctggctttgcgatggt

SEQ ID NO: 47481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaacacggatggctcctgttggcggtggg

SEQ ID NO: 47482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaacacgtagaaacattttataacgcgtt

SEQ ID NO: 47483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaacctggtatccaataatacgtatttcc

SEQ ID NO: 47484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaacgggcgtggctcacgactaacgagtt

SEQ ID NO: 47485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaagcacctagtggatccaccgccaactg

SEQ ID NO: 47486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaaggaatattttggctctagtcgctagc

SEQ ID NO: 47487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaagggccttctgaaaaggttcacgttac

SEQ ID NO: 47488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaatgtagcccagaaggcggtacttttgg

SEQ ID NO: 47489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaattactgtcctgagtatgcggtcgcct

SEQ ID NO: 47490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacaattgatcaccgtgccggtagttgct

SEQ ID NO: 47491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacagtgcgaggtaggggattgcggcgag

SEQ ID NO: 47492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacatcgtaatacgctataagaggcggct

SEQ ID NO: 47493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacatgcttctcaaaacgaaaggggtgtc

SEQ ID NO: 47494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaccatcggtgcgggcccataagggcgga

SEQ ID NO: 47495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaccatgttaaactaattccgcggataac

SEQ ID NO: 47496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacccggcacgattgagctgtgggtgagg

SEQ ID NO: 47497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaccttcgagctcattgtaaagaactaga

SEQ ID NO: 47498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgagagcatctttatagggctcgaatg

SEQ ID NO: 47499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgaggcggcttccacttcagcagcagc

SEQ ID NO: 47500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgattaagttagcattacggggatagg

SEQ ID NO: 47501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgcagggcctttttcgcgcgcgcccgt

SEQ ID NO: 47502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgcgacaacgtggtgacatgtgtgccg

SEQ ID NO: 47503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgctctcaagttcccttgaaatcttgg

SEQ ID NO: 47504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacggggcctctccaagcacgactgactt

SEQ ID NO: 47505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaacgtctagggaacatgcgctctcggtaa

SEQ ID NO: 47506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaactatctagcatcgtgccggattttgga

SEQ ID NO: 47507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaactcaagctggagaaggccggactggtt

SEQ ID NO: 47508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaactggcggcggcgaagagaggctgcgta

SEQ ID NO: 47509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagaagttagaatatctcatgagcacact

SEQ ID NO: 47510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagagcccggaaagccgatgcaagccgac

SEQ ID NO: 47511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagagccgccagccacaggagcgcggtgc

SEQ ID NO: 47512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagagctacgtccgtgttcatgatgccgc

SEQ ID NO: 47513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagaggtcattggaggatgctagactgcg

SEQ ID NO: 47514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagcaccctgccggaatctacattctgcc

SEQ ID NO: 47515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagcgctcgcagcgtcactccaattggtg

SEQ ID NO: 47516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagcgtagatgtctgccttatgactggcc

SEQ ID NO: 47517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagcgtcaactgtctcgaataattttgct

SEQ ID NO: 47518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaggacatcacgcaccttcgacagacccc

SEQ ID NO: 47519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagggcaaaggggactttcttcctcgtac

SEQ ID NO: 47520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagggcttcggtctaattgtgtcgccacg

SEQ ID NO: 47521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaggtggcgagcaattgagtttgcctgtg

SEQ ID NO: 47522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaaggttcagagaggggcagggtatcctcg

SEQ ID NO: 47523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagtgggcaggacgtatggcaaggaggtc

SEQ ID NO: 47524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaagttcgccgatggagtcaccttgttgct

SEQ ID NO: 47525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaataatagtttacactactttcgcccatc

SEQ ID NO: 47526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaataggtggcgtaccttgttcgggggtaa

SEQ ID NO: 47527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaataggttagcgagttcaggcccgggctc

SEQ ID NO: 47528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatcctcgacctcctgacgttacggagta

SEQ ID NO: 47529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatcgaccagcgcttagatgtttcccaga

SEQ ID NO: 47530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatgcaagtacaaagcatgggatgaaatg

SEQ ID NO: 47531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatgtacgaggctgggttggtgtggactg

SEQ ID NO: 47532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatgtggatgggacccgcgacgtcgtatt

SEQ ID NO: 47533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatgtttccctgcgcgctgaaaggttccc

SEQ ID NO: 47534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaattcgacagtgttgccgtagcgtttagt

SEQ ID NO: 47535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaatttaactcgttcggcatctcgctttgg

SEQ ID NO: 47536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacaactacggaggagctctgaacgcgttg

SEQ ID NO: 47537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacaagaattgggttcaggaccttagcttt

SEQ ID NO: 47538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacaatgttcccacaatggtaatggggact

SEQ ID NO: 47539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacacgatcgcgaaagcggtagcatgaggc

SEQ ID NO: 47540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacagagtgtcaatcgtagggctgacctgg

SEQ ID NO: 47541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacagccaaatgatgcaccgagtcgcggag

SEQ ID NO: 47542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacagccgcagtatctttcgcgggagctcc

SEQ ID NO: 47543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacaggtggatggcagatcattttgtgggg

SEQ ID NO: 47544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacatagcccccaatttcgtccgttggctc

SEQ ID NO: 47545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacatcaagggtacgagttcgccggagtgg

SEQ ID NO: 47546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacatgtacgatagtaacatactctgagcg

SEQ ID NO: 47547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccagattgcggaaaggttttcgttgctg

SEQ ID NO: 47548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccagggcacgaaagacaccttcatccgg

SEQ ID NO: 47549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccagtcacctcaagtgtaatggtagggt

SEQ ID NO: 47550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccattctacctcgtttgcccatactcga

SEQ ID NO: 47551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacccacgcgttctttgtagtggcctgaca

SEQ ID NO: 47552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccccacgctgctgaatgcttcgcttgag

SEQ ID NO: 47553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacccctatcggcaaggtctcgctatgggg

SEQ ID NO: 47554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacccgccacggcaaccacatctggtcatg

SEQ ID NO: 47555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacccttgatgcttaaccttactggggata

SEQ ID NO: 47556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgaacctgtatgtttaagagcgggggt

SEQ ID NO: 47557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgatgtcggtagtaagtaggttcaatg

SEQ ID NO: 47558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgattactctttaaaatactagtctta

SEQ ID NO: 47559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgcagactctcaacagggagctagatg

SEQ ID NO: 47560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgccagtaagatctaaaccaggccgag

SEQ ID NO: 47561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgccggcacagcatggtgaagggcggc

SEQ ID NO: 47562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccggacgtgtgttgacgagggagtttac

SEQ ID NO: 47563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgggaagagtgggacagcgagggttag

SEQ ID NO: 47564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgggcctgaacgagggggcataactgg

SEQ ID NO: 47565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccggggccgggcgatcctttatcaccca

SEQ ID NO: 47566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccggtaccctacctaatgactaaggcaa

SEQ ID NO: 47567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccgtagggaccaggtgagtaggcatcct

SEQ ID NO: 47568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacctacacataatgattgttctcgaggag

SEQ ID NO: 47569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacctccgaggcccaatcctttttctttaa

SEQ ID NO: 47570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacctggaagggcttgcttgtcgcgagggg

SEQ ID NO: 47571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacctgtagttattcaggaaagtccgttgt

SEQ ID NO: 47572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccttatgctcgttggggtaagcccagga

SEQ ID NO: 47573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaccttcctttgtctttgtacgaggtctgg

SEQ ID NO: 47574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgaacccttacctctctcggtcttcgtg

SEQ ID NO: 47575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgatgctacccgggcatggtggaacaca

SEQ ID NO: 47576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgattacaggcatgtcactttaagattg

SEQ ID NO: 47577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgcaccctgggtcactgaggcgggtctt

SEQ ID NO: 47578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgcacttatttgcgaccggttcatgtcc

SEQ ID NO: 47579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgcatacgacagatgtttttagtgcgcg

SEQ ID NO: 47580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgcgcggctgtactctaatgccatcatt

SEQ ID NO: 47581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgcggtattgcgggtagggatagcaaac

SEQ ID NO: 47582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggaacacgccaatcgcatgaccggggc

SEQ ID NO: 47583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggagctctcgtgttcggcaaattgttc

SEQ ID NO: 47584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggagggccgcttatctaggttatgggg

SEQ ID NO: 47585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggatggcagccgcagggtacacttatg

SEQ ID NO: 47586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggcccggatggacggcgtggagcgtat

SEQ ID NO: 47587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggctctgggcgcatcaattgtgcaggc

SEQ ID NO: 47588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgggcacgcgggcgccagccttcatcgg

SEQ ID NO: 47589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgggcggaaggacgttgagctgtacagt

SEQ ID NO: 47590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgggtcgcagccattgcttcgtaggcct

SEQ ID NO: 47591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggtccaaaaggaatgatgggattgcta

SEQ ID NO: 47592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacggttctaacttccacgggcgaaaataa

SEQ ID NO: 47593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtacacttcaattccgttccaagtacg

SEQ ID NO: 47594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtacgttacatgggcgcggtccatatc

SEQ ID NO: 47595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtagcatcaatacttgtctttgccagt

SEQ ID NO: 47596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtcccgcggtcggtgcgtgcagctgat

SEQ ID NO: 47597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtgccaacagtaggacacgcttgccaa

SEQ ID NO: 47598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtgcgagacgttgcaaacgcgtttttc

SEQ ID NO: 47599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtgtacatatatggggtgggtctcgga

SEQ ID NO: 47600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtgtctcgtgccttacttcggtacccg

SEQ ID NO: 47601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacgtgtgtcagtgtttgtgcggatggtcg

SEQ ID NO: 47602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactaagtccgaacgttctgattagtgctt

SEQ ID NO: 47603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactagcggggaggtcttgcgtagatcggg

SEQ ID NO: 47604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactaggcgaatccgattagtgcaacggag

SEQ ID NO: 47605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactatccaaagggggattgtatggtgctg

SEQ ID NO: 47606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactccgcccttagcgtgaccagttaggag

SEQ ID NO: 47607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactcgcgtagcgcgattgggcgcgtaagt

SEQ ID NO: 47608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactcggcagtttgacttaagaacgcgtgg

SEQ ID NO: 47609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactctgtctggtattgttgtcctcacgta

SEQ ID NO: 47610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactcttttcgtaatgagcattacacggtg

SEQ ID NO: 47611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactgcgcgccgctcgaccgtggctatatt

SEQ ID NO: 47612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactggaccctccttacgcatgtggagtcc

SEQ ID NO: 47613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactggcgatcgacacaccccaatagaagg

SEQ ID NO: 47614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactgtaagtgcataatcggccgcaccgag

SEQ ID NO: 47615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactgtccaccaagatacacgtcgtgtccc

SEQ ID NO: 47616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacttaattttcagacttgattgcaagttg

SEQ ID NO: 47617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacttacatatgctacgcatggagagtgtg

SEQ ID NO: 47618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacttcagcacggatgtctatacctttgtc

SEQ ID NO: 47619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacttgcttagcattgtatacggggtcgat

SEQ ID NO: 47620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaacttggcagtagaccgcagggacaagttg

SEQ ID NO: 47621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaactttggtatcacacgtgaagcaccacga

SEQ ID NO: 47622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagaaggcgaatacctgcgcaggaacgtcg

SEQ ID NO: 47623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagaagtgtgggacacggtgaggagctcgg

SEQ ID NO: 47624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagacaatatcaaccctgcctcacaaattg

SEQ ID NO: 47625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagacactcgccatgggcaccctctgttcg

SEQ ID NO: 47626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagaccagggcggattgactcgttgggtcg

SEQ ID NO: 47627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagacgtgctgggccctatcagcagctgag

SEQ ID NO: 47628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagagactaatcatgcatcggtcccaatgt

SEQ ID NO: 47629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagagttgcaggggaccgagagcggatggt

SEQ ID NO: 47630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagatgcaatcaccgactttcaccgcccat

SEQ ID NO: 47631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagatggctatcgtgcaattaggctgcaat

SEQ ID NO: 47632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagatgtctcaaggattcgtaatctgtcgc

SEQ ID NO: 47633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcaaacgaacgctggccccatcaagccg

SEQ ID NO: 47634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcaccgttagtcatttagactcgttcgc

SEQ ID NO: 47635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcattggagctctagtcgtccgcccgaa

SEQ ID NO: 47636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagccaacttgttcgcccgtatctgcttcc

SEQ ID NO: 47637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcccgagtggtggatttgaagctcgtcg

SEQ ID NO: 47638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcccgtgacggagagaaatcaatcggtg

SEQ ID NO: 47639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagccgcatgatcggaccgatgccgatgtg

SEQ ID NO: 47640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcctaggtcgatcccattcctcttttgc

SEQ ID NO: 47641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcgaacccgtgcgttgacgtttggttgg

SEQ ID NO: 47642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcgaattgggaccgtgtgaacggacgat

SEQ ID NO: 47643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcgacttgcggcgtgaggcatgccttct

SEQ ID NO: 47644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcgaggattttcagagtagggcctcggt

SEQ ID NO: 47645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcgccgattcttgcggcccggtcggtgc

SEQ ID NO: 47646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcgtcataaacaatcgttcttagtggtg

SEQ ID NO: 47647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcttacagggagaggtatcttgaaacgg

SEQ ID NO: 47648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcttgccgacttgaacagaaagttgact

SEQ ID NO: 47649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagcttgttgtactcgcgctctgggcctac

SEQ ID NO: 47650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggacaacgtcagccacgacaggtcgaat

SEQ ID NO: 47651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggacgcccatgcaggtccacagcatttg

SEQ ID NO: 47652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcacgcctcgggcaagttatggtcagc

SEQ ID NO: 47653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcactcagggtggggcagggttccggt

SEQ ID NO: 47654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcagtagatgtgttttctggggcaagg

SEQ ID NO: 47655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcatggaaccgaaagcgggcatgtggg

SEQ ID NO: 47656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggccgaccgcagtatgtacagggccttg

SEQ ID NO: 47657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcgaatctcgggagagctaccgactga

SEQ ID NO: 47658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcgagatcattcgggccccaacctcgt

SEQ ID NO: 47659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggcggcttgcagggcgttggagctcaaa

SEQ ID NO: 47660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggatgtcggtgaaacatggcatgggcg

SEQ ID NO: 47661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggcattaacagggagcaaggccgttat

SEQ ID NO: 47662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggccccggattgcaaacagaaacgtat

SEQ ID NO: 47663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggcgcaagacacgacgtgcatggcccg

SEQ ID NO: 47664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggcgtacataggttcctgtttatattc

SEQ ID NO: 47665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggcttattgtatggatattttgggtat

SEQ ID NO: 47666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggggaggcgccgggtcgaatacagccgc

SEQ ID NO: 47667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggggctaccctagctgaagactcgcacc

SEQ ID NO: 47668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggggctcatctgaccggagcatatagcc

SEQ ID NO: 47669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggggacgcaatcgggagtactacatat

SEQ ID NO: 47670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggggcgctatggatgaaccgggctgtg

SEQ ID NO: 47671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagggtgctccatggcgttcctgtacgaac

SEQ ID NO: 47672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggtagaaacggatttagctatcgccccg

SEQ ID NO: 47673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggtggatcgccagatcgagcgatcgtag

SEQ ID NO: 47674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggtgtcccgcccttattggcatgggtga

SEQ ID NO: 47675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaaggttaggtatttctaggccactgccgaa

SEQ ID NO: 47676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtcccgatccttagggtgtgatcttggg

SEQ ID NO: 47677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtcggcaatcgttattaccgggctgtgt

SEQ ID NO: 47678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtctgtttaatcggataccttcttcctt

SEQ ID NO: 47679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtgaatcgaacagtcgtgggatcaaggt

SEQ ID NO: 47680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtgagagcttactatccagcatagagcg

SEQ ID NO: 47681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtgagccggggcaggtccataattgcgc

SEQ ID NO: 47682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtggcgcgagacgtgagggcttgtgact

SEQ ID NO: 47683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtgttatctagaaagatcgatcgtcggg

SEQ ID NO: 47684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagttaattcttgtaatctgggcacagttt

SEQ ID NO: 47685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagttagaaacaaggcttgtattatataat

SEQ ID NO: 47686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagttagcgcgtgtcagtgcaggattgggg

SEQ ID NO: 47687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagttcggtggatggacgcgaggccgggtt

SEQ ID NO: 47688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagttctcagaggcccccgctccgtcaacg

SEQ ID NO: 47689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaagtttgaatgtttccatgctctagctctt

SEQ ID NO: 47690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaataaggctacatcacgtaattgcttatga

SEQ ID NO: 47691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaataagttggttcgcgcgtgctcttcgttg

SEQ ID NO: 47692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaataatgtttagatggtcttattccacttc

SEQ ID NO: 47693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaataattcgtgcagctggttgcggcctctt

SEQ ID NO: 47694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatacaaacagaaatggacatgtaatgccc

SEQ ID NO: 47695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatagcttgcacggccactttaggaaagca

SEQ ID NO: 47696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatataacacgtcactgtccgttcatctgt

SEQ ID NO: 47697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatatgagctatatcgccgggttctcttcg

SEQ ID NO: 47698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcaatatccggtgcttccgtttcgtggc

SEQ ID NO: 47699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcacgagcttctttcgtctcgtaatatg

SEQ ID NO: 47700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcatctcataagccgggcgttgcgtgcg

SEQ ID NO: 47701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcccggactcatatcatgatgccagacc

SEQ ID NO: 47702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatccctcagaggcggtacgtctatcggat

SEQ ID NO: 47703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatccggaccccgtaatctgactccggcga

SEQ ID NO: 47704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcctctaattttgtcgtccggttagggg

SEQ ID NO: 47705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatccttcttgtgctcttttggtaggttta

SEQ ID NO: 47706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcgcctctggttttcaggcctggacttc

SEQ ID NO: 47707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcggggtgttgcgtttcgtcattcgcgc

SEQ ID NO: 47708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcgtgtcggtcaaactagcgagccccct

SEQ ID NO: 47709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatctgttgccagccaccacgattatagta

SEQ ID NO: 47710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcttgaagcacttgtgatcacatattgt

SEQ ID NO: 47711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatcttgtgagccgctgaccccaacgtcgc

SEQ ID NO: 47712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgaccgacgacaaggcttactctgacct

SEQ ID NO: 47713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcaaacgggtcacgaaatgtcgggcgg

SEQ ID NO: 47714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcaggtgtaagatattgacagcgcccg

SEQ ID NO: 47715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcccgatgactatgcacagcagcttaa

SEQ ID NO: 47716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcgatcccggaacgctctttggataag

SEQ ID NO: 47717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcgcggacattgaactggcgaccggac

SEQ ID NO: 47718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcgtccaggagaggtttctaacaaaga

SEQ ID NO: 47719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgctgagacagtaataatggctgtcgtc

SEQ ID NO: 47720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgcttgcagccggcatgccccgaatcct

SEQ ID NO: 47721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatggatgtgaaatgcaggatgggattaca

SEQ ID NO: 47722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatggcgccggttctagttccatcgttccc

SEQ ID NO: 47723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatggcggtgatgtgggcacttgaattctg

SEQ ID NO: 47724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatggggccgcttggttgcagtattacgtc

SEQ ID NO: 47725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatggtccctatagccggagagtggtccta

SEQ ID NO: 47726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatggttagagaagtgcccggagtgatgta

SEQ ID NO: 47727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgtgcgtggtgatggtcggactgcgtta

SEQ ID NO: 47728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgtggcctcgtttaatcggcccaattct

SEQ ID NO: 47729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatgttttgcccgcaacccagggcagggcg

SEQ ID NO: 47730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattacctggaactgttgtctggctgctgg

SEQ ID NO: 47731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattagccccttggcgcgttacctgtatgt

SEQ ID NO: 47732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattatgaatcgcgttctctacttattgcc

SEQ ID NO: 47733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattcgatatttgatttagatatacggtaa

SEQ ID NO: 47734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattcgtactgatagagtttgtggctgcaa

SEQ ID NO: 47735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattgacctgtgtgggggtcttggttgata

SEQ ID NO: 47736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaattgtgcctggaatcggttgtttggttaa

SEQ ID NO: 47737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatttagggcgaggccgcatctcagattgg

SEQ ID NO: 47738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatttagtttctatgactaagagagggtgg

SEQ ID NO: 47739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaatttttcgagcgcaggatcacaaagcatg

SEQ ID NO: 47740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaaaccgggatgatgggccacggactgg

SEQ ID NO: 47741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaaacgccgcggtggtctatctccaagg

SEQ ID NO: 47742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaaaggagacccgcagctacatgctcga

SEQ ID NO: 47743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaacggctgggctcctcccttggaattc

SEQ ID NO: 47744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaagttagggcctcatctttggtggtga

SEQ ID NO: 47745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaatgcaggcaaacaggatgcgatctgc

SEQ ID NO: 47746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacctataagcgcatcatattcaccgcg

SEQ ID NO: 47747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacctccgcaaaggcatatccggagcaa

SEQ ID NO: 47748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacgaacatggcgagcactcacacttgt

SEQ ID NO: 47749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacggcgcgctatgacgagactcgaatt

SEQ ID NO: 47750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacgggacttttcagtcaacggggccgt

SEQ ID NO: 47751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaactctggtgctcgtgctgtatgcccgt

SEQ ID NO: 47752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacttatgttaacggctcgttgttggtg

SEQ ID NO: 47753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaacttttacgtctggagagaaattaccc

SEQ ID NO: 47754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaagaaggtgaggcgcattagttgcatcc

SEQ ID NO: 47755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaagaatgcggaagaacctggttcgcccc

SEQ ID NO: 47756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaagccgccatacgggtgacacttcacgt

SEQ ID NO: 47757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaagcgcccttgccgtaggagatggtatc

SEQ ID NO: 47758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaagcgggccgtacttggcatggttcgtg

SEQ ID NO: 47759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaaggcagaccttatgtagtcagcggatt

SEQ ID NO: 47760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatatacatagcacatttgccgtacttg

SEQ ID NO: 47761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatcaaagtaggatctcgctagggcctc

SEQ ID NO: 47762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatccttcaggcgtgctgtttgcggcgg

SEQ ID NO: 47763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatgagcacgtccggttgcagtacaggt

SEQ ID NO: 47764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatggcttgtctgtacttctgctgggtg

SEQ ID NO: 47765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatgtgcagcactatgctcgcctttgtt

SEQ ID NO: 47766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatgtgcagtcgttctagcattacgtga

SEQ ID NO: 47767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaattaggcgagttaggccggcctaatcg

SEQ ID NO: 47768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaatttaggtcagcaacgggtagcggcga

SEQ ID NO: 47769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacaatctgcgtgttgaattcgacttatt

SEQ ID NO: 47770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacaatttccgcctccggcctacgtacgg

SEQ ID NO: 47771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacagacgttcctcaatgaactctactcc

SEQ ID NO: 47772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacagcggcaactaaagctacacggactg

SEQ ID NO: 47773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacagttcagtttttacacggctccgtgg

SEQ ID NO: 47774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacatccggaggtcctcacatatatcgtt

SEQ ID NO: 47775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacatcgacctgggtgttagggcgcagtc

SEQ ID NO: 47776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacatgggttgttccttcgcgaatgtgtt

SEQ ID NO: 47777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaccaacgctccagccgctgatcagttgc

SEQ ID NO: 47778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaccaacgggccttcctctacagtccccg

SEQ ID NO: 47779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaccagtagaccaaacggtgataggtcgg

SEQ ID NO: 47780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacccaagttgctgtcccgtcagacgcgg

SEQ ID NO: 47781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacccgagtgcaaggagactcgaatgcgg

SEQ ID NO: 47782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacccggtgatgctgcggtgggttctttc

SEQ ID NO: 47783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaccgcaggtagctgatgaagggccgggc

SEQ ID NO: 47784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaccgctgatgtgtgtaccgattgccgag

SEQ ID NO: 47785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaccgtggtgaggactgaggtcccgaacc

SEQ ID NO: 47786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacctgcgcgcatcgttctactcgttact

SEQ ID NO: 47787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacctttccacgacgttccaggatccggg

SEQ ID NO: 47788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgaaagtgtgtcttagaagtacgccat

SEQ ID NO: 47789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgagattttacgaagtggaccgaccgt

SEQ ID NO: 47790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgagctaccttgcttctagactcgcca

SEQ ID NO: 47791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgccacgttgaaagcgttttcgaccgg

SEQ ID NO: 47792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgctcggaaaagttgctgtaggacgtg

SEQ ID NO: 47793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacggcgacagtggttgcctctctggtca

SEQ ID NO: 47794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacggcgctatgtcggttggttccaacgg

SEQ ID NO: 47795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacggcttctgtacgtccatgcacctggc

SEQ ID NO: 47796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacggtgtagcatcaggagcctcttgtcc

SEQ ID NO: 47797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgtactgaagggggattggggctcttc

SEQ ID NO: 47798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgtatggatctcatcactatgacacct

SEQ ID NO: 47799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgtctggccgggcgcttaagcgattgt

SEQ ID NO: 47800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgtgcggtttgggggctgacgattact

SEQ ID NO: 47801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacgtggccaattgaatcaggcctttgaa

SEQ ID NO: 47802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacactcagtttgcaatcgagggccccgttg

SEQ ID NO: 47803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacactcgggaacaacggtcgcatggacgcg

SEQ ID NO: 47804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacactcggtggaggctgcccatcgcgtcta

SEQ ID NO: 47805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacactggtgattcaacgccataagtgatgg

SEQ ID NO: 47806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacttaatgtattccagattggtaggcga

SEQ ID NO: 47807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacttaccggccaacttctggaaggcacg

SEQ ID NO: 47808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacttgatcgcgtatgtgcgtcttgcggc

SEQ ID NO: 47809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacttggagttgttgcgggggcttaactg

SEQ ID NO: 47810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacacttttttcataaatttctaagccgtag

SEQ ID NO: 47811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagacggtatgtcgcagtatgggcaatat

SEQ ID NO: 47812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagactcactcggaaagctagcgggcagg

SEQ ID NO: 47813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagagatcaagaccggtggcgttccacac

SEQ ID NO: 47814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagagggagcctgacggttgccgggggcg

SEQ ID NO: 47815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagagttacttggataggtaacgcaacgc

SEQ ID NO: 47816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagcagagatctgacccatcaggccgagt

SEQ ID NO: 47817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagccggcattgttacctgtgggtggctg

SEQ ID NO: 47818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagccggtagagcccacagtccgagtctc

SEQ ID NO: 47819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagcgtagacattgcggatattgtgaccg

SEQ ID NO: 47820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagctaatctctcgagatgcagtagtgtt

SEQ ID NO: 47821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagctagtatctccatggcggtttcggac

SEQ ID NO: 47822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggactccgccatactgcgatccttccc

SEQ ID NO: 47823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggaggaccagcgacacattgatcgcgc

SEQ ID NO: 47824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggagggtgtcatgtcgcccagtattgg

SEQ ID NO: 47825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggatggtctctgcaacgtgagggtagc

SEQ ID NO: 47826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggccattatctcgccatgtttccagag

SEQ ID NO: 47827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggcgatatcgcaggagattcgtcttgg

SEQ ID NO: 47828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggctatgatgtggtcgtttggtaatcc

SEQ ID NO: 47829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggctcaacggttatgacggcggatggt

SEQ ID NO: 47830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggctccattgacggtagtcctgtgttg

SEQ ID NO: 47831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggggccgcacagtactcaatcgtccct

SEQ ID NO: 47832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagggtgccgaggcaaaccggacaccagg

SEQ ID NO: 47833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggtaatgctacagcgttaggcataata

SEQ ID NO: 47834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggtcacgtgcagctggttagcgatgca

SEQ ID NO: 47835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacaggttgctgcgggagttaaccttcaaaa

SEQ ID NO: 47836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagtaaatagcgccgcaaatacaaatgat

SEQ ID NO: 47837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagtacaccctctacctaacgcgagtgat

SEQ ID NO: 47838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagtccatttttcttggtcgttggcctat

SEQ ID NO: 47839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagtggcgcgactgttacggggtcgtgag

SEQ ID NO: 47840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagtgttgacctacgcgtacgaaatcttg

SEQ ID NO: 47841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagttttagggacggagtctaagtttgtg

SEQ ID NO: 47842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacagttttcccatcgatgtagtctctgcct

SEQ ID NO: 47843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacataatcgatcagacgcattcttggtgtc

SEQ ID NO: 47844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacataatttcaaatcggaaaccggattatg

SEQ ID NO: 47845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacataggattggacacggtaatgggggcgg

SEQ ID NO: 47846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatagtattcacgggccccgtatggcgcg

SEQ ID NO: 47847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatatagacaacgcgacgtgtagcggtac

SEQ ID NO: 47848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatatagctccggcgccagggggtagtcg

SEQ ID NO: 47849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatatgactcttttcttggcatatgcatc

SEQ ID NO: 47850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatcaactgtcgaaacgaagctgcggctg

SEQ ID NO: 47851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatcattagggcagtgtctctgagtacca

SEQ ID NO: 47852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatcatttgtatatgtcttatatcttata

SEQ ID NO: 47853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatcgacgtgtggatgccgtccgtaaacc

SEQ ID NO: 47854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatcgcacttcgaccggaggtcggcgtat

SEQ ID NO: 47855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatcgtactacggatcgattgcattcgca

SEQ ID NO: 47856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatctgtgcagccgctctcctcgtactga

SEQ ID NO: 47857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgaacgtcgtaagtgccctctcccaac

SEQ ID NO: 47858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgaatcggtgcgtgcaaaaaatcagat

SEQ ID NO: 47859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgaatggaaactgctttaagaaactgg

SEQ ID NO: 47860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgagacatctgctggatcatagctaag

SEQ ID NO: 47861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgagttaagttggagttttgtatcagt

SEQ ID NO: 47862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgcctccaacttccatgcggagctgtt

SEQ ID NO: 47863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgcgctccttcttcactactacgggct

SEQ ID NO: 47864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatggtaatgccgatcaggggcaccttat

SEQ ID NO: 47865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatggtattgctggggaggcgaggagcct

SEQ ID NO: 47866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatggttttactggtgtggggtcttgcac

SEQ ID NO: 47867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatgtacacggcccgccgctcgcacgact

SEQ ID NO: 47868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacattaagacgaggcgtgcacgtggcgcga

SEQ ID NO: 47869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacattagtaacccctgcgacggtggattgc

SEQ ID NO: 47870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacattatcggcgccataattttttttcggt

SEQ ID NO: 47871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacattatgaacggcacgtagtgtccagggt

SEQ ID NO: 47872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacattcacacttgcctgggttgctcgtctc

SEQ ID NO: 47873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacattccccgatacaacgtttgatttcttt

SEQ ID NO: 47874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatttcagatcattcgacctttgccgagt

SEQ ID NO: 47875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatttgaagtcttgcgggcatgtcgtcac

SEQ ID NO: 47876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacatttgcatgctgttcatgcgtgtagggc

SEQ ID NO: 47877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaacactgcagtcgttcacgcttgccgc

SEQ ID NO: 47878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaaccacgtaagagctgtgtcaggtcgg

SEQ ID NO: 47879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaacgatactcgggattgcctccatggg

SEQ ID NO: 47880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaactagcaggggtcaaaaactcatgtc

SEQ ID NO: 47881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaagactcggaccggaggacggggagaa

SEQ ID NO: 47882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaaggcaggcttaggtttggaatcccga

SEQ ID NO: 47883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaatgaccgattatagatcctttagtct

SEQ ID NO: 47884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccaatttaacttgcttttcttcgcataca

SEQ ID NO: 47885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccacccgccctcgtgcagtatttatggga

SEQ ID NO: 47886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccacgagaatttggcattggtgcatgctt

SEQ ID NO: 47887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccacgagctcgctacgcattcaaggggga

SEQ ID NO: 47888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccacgggatcggtcttgtcacgccacctt

SEQ ID NO: 47889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccacgtggttttggggtgctgctgctgtt

SEQ ID NO: 47890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccacgttttgtcccgactgagatgtttca

SEQ ID NO: 47891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccactcgcgttatacgaagttctgtatgc

SEQ ID NO: 47892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccactgtacacgctggctaggtatggtgt

SEQ ID NO: 47893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccagaacctggtctgtatgtctctcgtcc

SEQ ID NO: 47894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccagaaggggccagctgacttgtgtaaaa

SEQ ID NO: 47895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccagaggtcttcttcattcaagcattttc

SEQ ID NO: 47896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccagtacgacggcgtttcgggtcttcaag

SEQ ID NO: 47897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccagtcgctgccgcaaaaatacgggggtg

SEQ ID NO: 47898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccatatcggcggggggcactcgttagctg

SEQ ID NO: 47899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccatcgaacgggctgttgtggatagtgcg

SEQ ID NO: 47900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccatcgcacgagagcgccatatacacgca

SEQ ID NO: 47901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccaatcctcgctacatctaaggtaggat

SEQ ID NO: 47902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccagcgcggaagtcaaacccgtgttgcc

SEQ ID NO: 47903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccgacaaagcagttgggagtggaattct

SEQ ID NO: 47904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccgcgctgcctaatacatgccttatcga

SEQ ID NO: 47905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccggaccttacctcggtgccggtagccg

SEQ ID NO: 47906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccgggaaacggacgttcagccgtctgta

SEQ ID NO: 47907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacccgggactatgcagagctcatcgttgaa

SEQ ID NO: 47908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccctaaggtgcgtgctgctaatcgggcga

SEQ ID NO: 47909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgaaagtgggattaagtgctgagttgga

SEQ ID NO: 47910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgaagcgatcagacgtggatacttggat

SEQ ID NO: 47911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgacctctagggattgtttccgttggtc

SEQ ID NO: 47912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgagattatgtgacggtgagtcctccaa

SEQ ID NO: 47913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgatctgtagacacgttgcgctaaggcg

SEQ ID NO: 47914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgatctgtaggacatcctcgtcaagtgc

SEQ ID NO: 47915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgcactccggttgacgggcaagtctatg

SEQ ID NO: 47916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgcatgccggcattccgcagggggaggc

SEQ ID NO: 47917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgccatgtagggggctaagtctttgtat

SEQ ID NO: 47918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgccgcgttcccggtgcctgcattcgat

SEQ ID NO: 47919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgcggacaatgtcacgagtgagtgtgcg

SEQ ID NO: 47920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgctatcgtgttgtgcagatttccaagg

SEQ ID NO: 47921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggacaggcattacgaaacatgtgttga

SEQ ID NO: 47922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggatgaagtggggacacttgctgggac

SEQ ID NO: 47923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggcaggttgagctgaagagaacagttt

SEQ ID NO: 47924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggcatgccagtcatggaatagtagttg

SEQ ID NO: 47925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggcgaacaaaagccctagacctctcat

SEQ ID NO: 47926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggctatatctgtctcggctttgggata

SEQ ID NO: 47927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggctgggaatatttgcaccttcatctc

SEQ ID NO: 47928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgggacgtcataccccccaccactgatg

SEQ ID NO: 47929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgggatactgctcttacgcgaggtgtta

SEQ ID NO: 47930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggggtctgatagcattggttgacgggc

SEQ ID NO: 47931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccggtcgggtggtaagcctttggtaatca

SEQ ID NO: 47932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtagcgattgtagttcgttcctagtgg

SEQ ID NO: 47933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtagtgaagcagcccgacatcaaaagt

SEQ ID NO: 47934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtatccacgctctcttggccggaatgc

SEQ ID NO: 47935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtcaaaaggcgttgcgttaatatggag

SEQ ID NO: 47936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtcatgcccgccagcacatcctgcttc

SEQ ID NO: 47937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtcattgtttacggcgtgacaggtcgt

SEQ ID NO: 47938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtcttaggcagtgtgagggcgggcgat

SEQ ID NO: 47939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtgactcaggtttctgccatcgacata

SEQ ID NO: 47940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtgcgaccctatcacacccggcgatac

SEQ ID NO: 47941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgtggatcgtgtgtgcattaccacggca

SEQ ID NO: 47942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccgttctgtttccacactcgttagaggat

SEQ ID NO: 47943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctcacgcttgggttagttcgcaatacat

SEQ ID NO: 47944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctcagacagaccggccctcccgcccgtt

SEQ ID NO: 47945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctcctgggatgtcgataatcgcggtgcc

SEQ ID NO: 47946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctcgcagaaggaaggatcgagacggatc

SEQ ID NO: 47947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctcgcataaaagtcaggaaccatgttgg

SEQ ID NO: 47948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctcgcgacgagattcggcgtccggatgc

SEQ ID NO: 47949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctgctctcgagacggatcattcggggct

SEQ ID NO: 47950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctgctgcaatagccgttacagcgactgc

SEQ ID NO: 47951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctggaaggtacaaatacgtttaccctga

SEQ ID NO: 47952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctggagtcgtctagtccgatgggatcca

SEQ ID NO: 47953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctggatggatcccttgttgctgtaggcc

SEQ ID NO: 47954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctgtgcacacttgccagccgacccagtt

SEQ ID NO: 47955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccttacgcacaacggtttgtcgtatcctc

SEQ ID NO: 47956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccttgagtctctgttcagcgccgagatcc

SEQ ID NO: 47957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaccttgggaccaacgctatccactggagtc

SEQ ID NO: 47958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacctttgagcgatgataatctctctggttc

SEQ ID NO: 47959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaacggacagggtgattgtggctttggg

SEQ ID NO: 47960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaagcgtgtcacgttttgaatagcgtac

SEQ ID NO: 47961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaatctcagggaattggcattctgggaa

SEQ ID NO: 47962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaatgaccaggttaggtcctattagctt

SEQ ID NO: 47963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaatgcggatctaccagctgtagtctcg

SEQ ID NO: 47964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgacagcggtggtgcgcgtgctggataaa

SEQ ID NO: 47965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaccaactgcccgtagtatctctcccgt

SEQ ID NO: 47966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaccatagtgtgaggtctttattacccc

SEQ ID NO: 47967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaccgcacccgagcaactttatgatttt

SEQ ID NO: 47968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaccgtggggtgggctgccagtactctc

SEQ ID NO: 47969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgacggaatcatgctctatttctgaggtg

SEQ ID NO: 47970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgacgtaaagctcggaaggttcgtgggca

SEQ ID NO: 47971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgacgtaatagccactttctcgattcggt

SEQ ID NO: 47972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgactagggggggctgtttgattctgccc

SEQ ID NO: 47973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgactctaaatattgttccaaatgcgcac

SEQ ID NO: 47974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgactggattatccagtttaccacttgat

SEQ ID NO: 47975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgagatctcaaaggtggactgcacaactg

SEQ ID NO: 47976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgagcgaagaagggtggccacagataatg

SEQ ID NO: 47977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgaggctcggtgtctccctagacgtgggc

SEQ ID NO: 47978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgagttaggggccttgaatccaaacagct

SEQ ID NO: 47979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgagtttaccgatcttgtatgcagcccgg

SEQ ID NO: 47980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgataagcgatgtgaaatactattgttcg

SEQ ID NO: 47981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatacgccaatgtgacttcaagtatgca

SEQ ID NO: 47982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatagggccttgtgtttgctacggctgt

SEQ ID NO: 47983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatagggcgtcaggccgtcttgcatagt

SEQ ID NO: 47984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatatatatgttgcgaagtgtttatcaa

SEQ ID NO: 47985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatcatctcaacgggcacttgtggagca

SEQ ID NO: 47986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatccaccttcagtagagagggtacgcg

SEQ ID NO: 47987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatgagtagtccatattctctttcttta

SEQ ID NO: 47988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatgattgacctgatcgagtgtcgtgtt

SEQ ID NO: 47989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatgcggagaaaaggtaagaggagcaca

SEQ ID NO: 47990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatgtagctatctgttgctatcccccgt

SEQ ID NO: 47991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgatgttccggagggcaagtgggcacgcg

SEQ ID NO: 47992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcacagagagtccatgagaggagtctca

SEQ ID NO: 47993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcacgatcgtcaatatcttattccgcct

SEQ ID NO: 47994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcacgcctccgctagtgttgctcttaat

SEQ ID NO: 47995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcacgtagtataggacggtctgccgttg

SEQ ID NO: 47996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcagaaagcgctctcactgagtctgagg

SEQ ID NO: 47997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcagccgcatgccccacgccgtaatcgt

SEQ ID NO: 47998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcagccttagatcaactacacgcgcgac

SEQ ID NO: 47999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcagtcggataagtagatcccgaaccca

SEQ ID NO: 48000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcatcggattgccacatccacagctcgg

SEQ ID NO: 48001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcatgacgataatgggcacaatccgatg

SEQ ID NO: 48002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcatgctttccgttgttctccacctgcc

SEQ ID NO: 48003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccatggcagaggagcgaaccggtgtgg

SEQ ID NO: 48004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccgactcctgcaacttgcgttccatcg

SEQ ID NO: 48005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccgagccggttacgcgacacacattcg

SEQ ID NO: 48006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccgcatcacgcgtggtctggtcagggt

SEQ ID NO: 48007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccgccacgattagttgtagtgggaggg

SEQ ID NO: 48008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccgctgaagcatcatccgcatctgttc

SEQ ID NO: 48009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccggaacagaggatgggttctgcattg

SEQ ID NO: 48010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgccggcttactttcagagtcatataaga

SEQ ID NO: 48011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctcagatttattacgtgtggggtgat

SEQ ID NO: 48012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctcggatattccgagtcatgagccac

SEQ ID NO: 48013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctggacttcacggccctggagctggt

SEQ ID NO: 48014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctggctgcttatcgttacgtttctgt

SEQ ID NO: 48015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctgtcatgttatgcggagcccggcct

SEQ ID NO: 48016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctgtgtgggctcctacggcaaccctg

SEQ ID NO: 48017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcctgtttgggtatcggctcgggggaag

SEQ ID NO: 48018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgaacgaaagctctggcctgaacaacg

SEQ ID NO: 48019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgactgtgcctgacggtacgatgtgtc

SEQ ID NO: 48020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgatgcctccttggtaggtgataatcg

SEQ ID NO: 48021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgcagtgtcgcttcaccgaagcccgcc

SEQ ID NO: 48022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgcctggtgattactcatggatcggtt

SEQ ID NO: 48023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgcgagacatatgcgacgcacgcggag

SEQ ID NO: 48024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgcgcggagttgtggtggccggaccac

SEQ ID NO: 48025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgctccattcgctcgccaatctcatag

SEQ ID NO: 48026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggaacggcctatgatgggccgcttga

SEQ ID NO: 48027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggaattgatggtgtgtaacgtgggtt

SEQ ID NO: 48028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggacgaagtgctcgtttactgggtca

SEQ ID NO: 48029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggagcctgcacgaatccctagagcac

SEQ ID NO: 48030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggaggtcgacaatgaggcgcgggtga

SEQ ID NO: 48031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggccttctacacccggactgcgaagt

SEQ ID NO: 48032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggcggagggcatagctgtacctcggc

SEQ ID NO: 48033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcggttcgcatcttgggggatgggctgg

SEQ ID NO: 48034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcgtgctgcatgttcagggcattgggta

SEQ ID NO: 48035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgctcctatttcccatgggagttgtggcg

SEQ ID NO: 48036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgctcgtgtctttgatcggtaatgccgcc

SEQ ID NO: 48037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgctctaaaccgggctttctggatgtgca

SEQ ID NO: 48038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgctctgttgagtagataaatcttgacct

SEQ ID NO: 48039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgctggtgattgttgaatgtgttagtgtg

SEQ ID NO: 48040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcttcgaaggtggtgaacgggaggccga

SEQ ID NO: 48041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgcttggttgtacgtgcatagcttggtgg

SEQ ID NO: 48042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggaataggtcgttcattgtcggaccggg

SEQ ID NO: 48043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggaatgcccgatgactggtgttggcgcc

SEQ ID NO: 48044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggaccttaacaaagaatccttggcaggg

SEQ ID NO: 48045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggacttggattagggtacagaagatggc

SEQ ID NO: 48046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggagctggccacaaccttggtagatggg

SEQ ID NO: 48047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggagggtatgggccgcgccgggggaagt

SEQ ID NO: 48048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggatagggtctggagggcggcgactctg

SEQ ID NO: 48049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggatagtttgccgcgcgtgctcaagtgc

SEQ ID NO: 48050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggatcaccacgaatcgatccattttgca

SEQ ID NO: 48051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggatcgacgggcatctgggaggaccttt

SEQ ID NO: 48052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggatcgccaaatcgccacggggagtgcg

SEQ ID NO: 48053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcaacagatccacaggccaggggacgt

SEQ ID NO: 48054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcaacatggcagacgatctggggaacg

SEQ ID NO: 48055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcacaacacaactagcgttagttgagc

SEQ ID NO: 48056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcacaggccgcggttagcggcaggttt

SEQ ID NO: 48057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcacccgggtatatcggaaacgagtat

SEQ ID NO: 48058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcagccaaagggtcaattaggtcggaa

SEQ ID NO: 48059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggccacggggatgtgttaattgccatcg

SEQ ID NO: 48060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggcccaaaatgttgtctttcatggcagc

SEQ ID NO: 48061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggccgtttacatcggtatcaatgccccg

SEQ ID NO: 48062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggctacagactatacgcgcgcgcgacct

SEQ ID NO: 48063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggctagggtataacaaactggtctgccc

SEQ ID NO: 48064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggaaatgcacgtcgaagttcacccacc

SEQ ID NO: 48065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggactgggaaccggtgtgttcagcctc

SEQ ID NO: 48066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggactgttcttctcgacggttatttat

SEQ ID NO: 48067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggacttccgtcagcttggtcaaaccgc

SEQ ID NO: 48068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggaggcgagcgcacggaggatacaacg

SEQ ID NO: 48069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggagttatttaggcagggattcactgg

SEQ ID NO: 48070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggcatttaggtttctgtagacgttgtc

SEQ ID NO: 48071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggccacaagcataggcaagagacgggt

SEQ ID NO: 48072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggggaccggtgcggtgtgtcagctttct

SEQ ID NO: 48073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggggatatcggatgtcaggcggttccgg

SEQ ID NO: 48074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggggcgatcgggttgccctggctcttac

SEQ ID NO: 48075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggggggtagttaggaattgacgatcagc

SEQ ID NO: 48076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggggtaccaatcctatacccggtgtcg

SEQ ID NO: 48077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggggtatgtcactcgggtcgaggatggg

SEQ ID NO: 48078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggggttctgcctagttataggtattccg

SEQ ID NO: 48079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggtatttctcgttttggtagcgcacca

SEQ ID NO: 48080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggtggtgtgcaatttacacagaaacca

SEQ ID NO: 48081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgggtttgcttcgcccatggagagttgcc

SEQ ID NO: 48082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtaattcattgcgttctttaatgcgcc

SEQ ID NO: 48083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtacctgcccgggatcctcacaccgga

SEQ ID NO: 48084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtatcgccctgctcgggttcggcctct

SEQ ID NO: 48085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtcaccgtgcgcgcgtgcaccccgcga

SEQ ID NO: 48086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtccgggtcagcgccatacgaggatgt

SEQ ID NO: 48087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtgaatgcgtagcagcggctcttggat

SEQ ID NO: 48088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtgagggaggcgagatatggcatgctg

SEQ ID NO: 48089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtgctatcacgttacaacagttcttcg

SEQ ID NO: 48090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtgctgggtacacgatccagttctgcg

SEQ ID NO: 48091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtgggggtggaaggtgctgtcagaaga

SEQ ID NO: 48092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggtgttgagcgagttgtaggggtcctcg

SEQ ID NO: 48093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggttcacacatgcccggttcactaggcc

SEQ ID NO: 48094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacggttgtagcgtgcgggtaggtatatatc

SEQ ID NO: 48095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtaatgcgatggtaggtccgacactgcg

SEQ ID NO: 48096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtacgtgggtgggcgaagggcctggttg

SEQ ID NO: 48097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtagtgcaggggggagacagggtgctcg

SEQ ID NO: 48098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtatgagagagtcaatggaagccggtgc

SEQ ID NO: 48099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtccaaggcccaccaacagcgtgttgag

SEQ ID NO: 48100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtccattagcgtgagggcatggctcgca

SEQ ID NO: 48101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtcctaatctccaacaagaggccgccgt

SEQ ID NO: 48102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtccttcgttgtccgttgaccgtacgtg

SEQ ID NO: 48103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtcggctcgaagtagctgccactgcact

SEQ ID NO: 48104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtgaagtccgacctacactttgactctt

SEQ ID NO: 48105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtgagaaggtctcttgatcccttgcgcc

SEQ ID NO: 48106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtgccatccgagtacgaatagtcttggt

SEQ ID NO: 48107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtgccgggatacgtactacggctccagg

SEQ ID NO: 48108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttaaggatttatcgtagcattctcgtg

SEQ ID NO: 48109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttcaaaccatcgatgggcggggcggct

SEQ ID NO: 48110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttcgtttaagacgaggatgctccatga

SEQ ID NO: 48111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttgaaacggtgccgtatgtaccgcttt

SEQ ID NO: 48112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttgattcatgctccttgtatcttgtcg

SEQ ID NO: 48113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttgcgccacggccgaacaggagtcggc

SEQ ID NO: 48114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgttgttcctgtccgcttccaagggtttt

SEQ ID NO: 48115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacgtttttgcgttctggatagtaaaaggtc

SEQ ID NO: 48116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaaaacgcggcgacgtattactttgaat

SEQ ID NO: 48117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaaagctcttcggtcatcggctaagtcc

SEQ ID NO: 48118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaacaatctgtctgtagttctggtcctt

SEQ ID NO: 48119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaacgaacaccctctctaggccatgcga

SEQ ID NO: 48120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaactatgacatccgtaagagtgcatcc

SEQ ID NO: 48121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaatgggactacgcttggatgcagcagc

SEQ ID NO: 48122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactaattgtgtattgtttacctattgcgcg

SEQ ID NO: 48123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactacagcgcttctagtgcattcgggagta

SEQ ID NO: 48124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactacagttcaggatcgtagttgccgtctt

SEQ ID NO: 48125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactacgcggatacgctctcgtgtgacctgg

SEQ ID NO: 48126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactactgctcgagagactgcctcaccggat

SEQ ID NO: 48127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactactttcattgatcatcgtttgtctttc

SEQ ID NO: 48128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactagcggtcagcgtgatattcgttgtgcc

SEQ ID NO: 48129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactagggcgggaatgttaaacggtggtggc

SEQ ID NO: 48130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactatcgctgcaatttcagggtttctagta

SEQ ID NO: 48131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactatgaataaagaacttatgtgggcgctg

SEQ ID NO: 48132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactatggtcttaggacggtcctgcaccgcg

SEQ ID NO: 48133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcaattatgcggtgaccgatgcaccctt

SEQ ID NO: 48134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcacctttatgagcactgtaatgggagg

SEQ ID NO: 48135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcacggccgcgatctggggggtgggtcg

SEQ ID NO: 48136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcattaccttcgtgccatgcgtagacgc

SEQ ID NO: 48137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactccacccaacccctgaattctgagggct

SEQ ID NO: 48138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactccacggatgcgtggtttagcttacaga

SEQ ID NO: 48139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactccgacaagtcacaacatctgatccgag

SEQ ID NO: 48140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcctagtctgcgtacgtcttggcaccgt

SEQ ID NO: 48141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcctgggtatagataggacctgtggcgt

SEQ ID NO: 48142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactccttcggcctttcttttgcccgcgctt

SEQ ID NO: 48143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcgaactaaatctgccacgcctcgctat

SEQ ID NO: 48144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcgccctagtagcgtgatgttccggtcg

SEQ ID NO: 48145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcgcgcagtggcatacatcgattccaac

SEQ ID NO: 48146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcggagccgaatccggcgagccaccgcg

SEQ ID NO: 48147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcgggttgtaaattaggcgccgtagtct

SEQ ID NO: 48148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcgttatcgtcgaatggagttgtgaagc

SEQ ID NO: 48149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcgtttaggcgttacgtgacggaagtgt

SEQ ID NO: 48150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctacacggcgcgtaaaggcacagcact

SEQ ID NO: 48151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctagcggtcaggctcaagttagacgcg

SEQ ID NO: 48152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctagttcatttttacgaacacgtttga

SEQ ID NO: 48153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctcggactggtcgtgatggctttgttg

SEQ ID NO: 48154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctgacggacttgcgggatcgaggtacg

SEQ ID NO: 48155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctgcgcatgccttcgcgtaagtgtttg

SEQ ID NO: 48156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactctggtttgtatcactgggtaagctccg

SEQ ID NO: 48157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcttactggctagtgggtggtgaatggg

SEQ ID NO: 48158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcttcggctactcgtgaacgcacggtcg

SEQ ID NO: 48159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactcttgggctgaacttacgatgaatctgc

SEQ ID NO: 48160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgaaagtggcgagtgcggtattatcgct

SEQ ID NO: 48161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgaactgccgccagctagtggaggtgcg

SEQ ID NO: 48162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgaatcacccgacatctttatcaacgct

SEQ ID NO: 48163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgacaaaacgtttccgctatgttgacaa

SEQ ID NO: 48164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgacacgtggtatttcagtgcgtttggg

SEQ ID NO: 48165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgagcttgcctctacagcttgggttctg

SEQ ID NO: 48166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgcagggggtgccactggacctcgcgga

SEQ ID NO: 48167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgccgtggttgctgcgggttggatatac

SEQ ID NO: 48168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgcctaggtttgctattagctatgtgca

SEQ ID NO: 48169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgcgcgcacgaggttttttatgttctcg

SEQ ID NO: 48170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgcgtttcatgagctctattgcctggga

SEQ ID NO: 48171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactggaccttccttgcatgcagtgccgacg

SEQ ID NO: 48172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactggagttggttattgttatcccccactt

SEQ ID NO: 48173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactggcatcgttcatatcttggagcgcgac

SEQ ID NO: 48174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactggccttgtcatcggttgttggcaatac

SEQ ID NO: 48175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgggctgtgtccgttagggtgtgcttcg

SEQ ID NO: 48176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactggtactgctcactctgccgcctaagtt

SEQ ID NO: 48177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactggtatcgccactcatgcatatctcttt

SEQ ID NO: 48178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtatcaacggactgtcagcctggtctt

SEQ ID NO: 48179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtatctccggcgtgcaaagaccgccac

SEQ ID NO: 48180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtatgcagcgaatcatccgtcggtgct

SEQ ID NO: 48181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtccgcagttcgctgtcgtgcattttt

SEQ ID NO: 48182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtctaggtccgttacaaccccagcagg

SEQ ID NO: 48183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtcttggttaatgggatagacggttta

SEQ ID NO: 48184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtggtgtgggaatcagacccatccgta

SEQ ID NO: 48185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtgtgttgcaattgtctaataaagtaa

SEQ ID NO: 48186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtgttgccactcacttcacccccttcg

SEQ ID NO: 48187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgttgcccaccgcagggttccaggccgt

SEQ ID NO: 48188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactgtttaggatctggattttgttctgcct

SEQ ID NO: 48189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttaacgctagtatcgcgaactaatgtta

SEQ ID NO: 48190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttaatgcttctcgcggtgggattggatg

SEQ ID NO: 48191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttaccgcgacacatgaaccgaaactact

SEQ ID NO: 48192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttagcacggaactggagatgccgagggc

SEQ ID NO: 48193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttagcagtgagacgccggatgggggccc

SEQ ID NO: 48194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttagccccaattacatgtttagattgtt

SEQ ID NO: 48195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttcatttgccgggtctcaatacgggagt

SEQ ID NO: 48196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttccggggctggtttccactgttggtac

SEQ ID NO: 48197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttccggtatgactgatgcggtcaaccac

SEQ ID NO: 48198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttcggtaaggatcgtgggtggtgttgca

SEQ ID NO: 48199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttcgtgcatgggtcggtcctgttcggaa

SEQ ID NO: 48200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttctagcccgtggataacgcattcctgg

SEQ ID NO: 48201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttctccgccgagatctggtattcaactc

SEQ ID NO: 48202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttcttcacaagggtttcagttgcggagt

SEQ ID NO: 48203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttcttgaatggttgcagattcgatgcca

SEQ ID NO: 48204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttgagtcaggagcagctgcagttggctg

SEQ ID NO: 48205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttgcgtcttctcgaacggcttgcggatg

SEQ ID NO: 48206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttggcacgcaggctcaaacggtcttgct

SEQ ID NO: 48207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttgtcaatttgcgacgatcggatctccg

SEQ ID NO: 48208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactttccggtattcattaggcttggcaatt

SEQ ID NO: 48209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactttgaactcgatgcaaacggattggcct

SEQ ID NO: 48210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactttgatttgatcgtcacggttgcagtgg

SEQ ID NO: 48211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactttgcccgatgaatcggtgggagagtgg

SEQ ID NO: 48212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactttggcatagttgaatgacagccgttgg

SEQ ID NO: 48213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggactttggccgttccattgtaatgattgtcc

SEQ ID NO: 48214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggacttttggatttcactcaatcatctagtgt

SEQ ID NO: 48215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaaaaggccgtggcttcattatcagtcat

SEQ ID NO: 48216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaaactgactactccaatggatttgctgc

SEQ ID NO: 48217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaaaggcacaagaccctgtctttggtacg

SEQ ID NO: 48218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaacatttcaaccgcacctttgattggtt

SEQ ID NO: 48219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaaccttgcggctggtctacgtatccgcg

SEQ ID NO: 48220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaactagggaacgactgctggcgtccgca

SEQ ID NO: 48221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaagctacaagtcgactggccgggtgtgg

SEQ ID NO: 48222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaagctcgcaagttcgtgataggtggtat

SEQ ID NO: 48223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaagctgtgctctcgggctctgctgaacc

SEQ ID NO: 48224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaaggcgaaggtttgcagcgaaggaaggg

SEQ ID NO: 48225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaagtattagggccccgccgtagtgcacg

SEQ ID NO: 48226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaagtgtgcagtttcgttcgctcagggtc

SEQ ID NO: 48227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaattaggaggcggcagctggcgctatcg

SEQ ID NO: 48228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacaaccactgccacactcgttctcgtca

SEQ ID NO: 48229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacacgtttgtagttaccgtcgccacgtt

SEQ ID NO: 48230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacaggtctcgatcgactcggggtgcccc

SEQ ID NO: 48231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaccatcgcttttcgtgccaagtggcggc

SEQ ID NO: 48232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaccgatgcaggccatagtgcgcccgtag

SEQ ID NO: 48233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaccgggcagcgtgcgtgtgatacgggag

SEQ ID NO: 48234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacctgaagggggggtacgccgggacctg

SEQ ID NO: 48235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacgcatcgtttcgggcatgcaattctta

SEQ ID NO: 48236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacggaaccggacccacgacgtatgccgc

SEQ ID NO: 48237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacggaggaggttacccaggctgaggact

SEQ ID NO: 48238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacggggaaaaccacggacctgctgcgcg

SEQ ID NO: 48239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactaactcaggctctcagaattattctt

SEQ ID NO: 48240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactacgcttctcgagcccaacaaggttt

SEQ ID NO: 48241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactatcgtcgcgttgacgcggaccgggt

SEQ ID NO: 48242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactcaccctccggaaccaggtgcgaatg

SEQ ID NO: 48243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactcttttcaagatttgtgcagagttgc

SEQ ID NO: 48244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactgatttatccccggacacggctcacg

SEQ ID NO: 48245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagactgggacagcacaacgccgggcaaacg

SEQ ID NO: 48246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagacttagtcaggcccgaagtagagtagcg

SEQ ID NO: 48247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagaagagaagtaccgccggtcatccttg

SEQ ID NO: 48248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagaatttcagcaccggagcgtgataggg

SEQ ID NO: 48249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagaggggtaaggagtcatcactgcctta

SEQ ID NO: 48250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagcagccatgcaagcagaataatttggt

SEQ ID NO: 48251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagcagcggtgtgtcgacacaggcagtac

SEQ ID NO: 48252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagccaaccaggtagcgccaggcgcatgt

SEQ ID NO: 48253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagccattgcctaccatcgtccgtccatg

SEQ ID NO: 48254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagccccactcagacgaacgtcattccgc

SEQ ID NO: 48255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaggcgttccatgggggcgtgcgcaacgg

SEQ ID NO: 48256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagggtcagactgctgagaaaactcgagt

SEQ ID NO: 48257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagaggtctggggaagatccggtaatacgcg

SEQ ID NO: 48258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagtctgtggggatctcgtggagatgtgt

SEQ ID NO: 48259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagtgggggcgttataacgtgggactcat

SEQ ID NO: 48260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagagttcgtagcaacggggcgctttgtttg

SEQ ID NO: 48261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagatccctagtattcgggacgctaacgcct

SEQ ID NO: 48262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagatcgtacctgcaattttacctctcgggc

SEQ ID NO: 48263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagatcgtggaggctcgattggccccgcgct

SEQ ID NO: 48264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagatctgaaaccaatggtcaaacgccgacg

SEQ ID NO: 48265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagatctgcataggcagacgatgactcagcg

SEQ ID NO: 48266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagatgtacaaggttattcaggtggcttcga

SEQ ID NO: 48267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagattgaggtccgagacactcgcgaaatca

SEQ ID NO: 48268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagattgattgcgatctaatcctggtgctcg

SEQ ID NO: 48269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaaaacacaacgctggaccagggttggg

SEQ ID NO: 48270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaaacaggtcgacatttgtgggctcgcg

SEQ ID NO: 48271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaaaggggcgcggcttttacgcactgtg

SEQ ID NO: 48272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaaccgagcttgcctgacagtttgtgaa

SEQ ID NO: 48273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaaccggggatgccttatcttgggttag

SEQ ID NO: 48274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaacggtatgtgatccggaagaactcgt

SEQ ID NO: 48275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaactgtaacggtcaatttgtccctttt

SEQ ID NO: 48276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaagcggcgtcttcagtgaacggacgca

SEQ ID NO: 48277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcacagtttgtagttacatctgcagagtt

SEQ ID NO: 48278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcagcaagtcgggctttgtaaggccacgc

SEQ ID NO: 48279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcagcagtgaaagcttgtcagacaagggc

SEQ ID NO: 48280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcagcgtgtagggtctggctggtggcggc

SEQ ID NO: 48281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaggcattcacgggatcagcttaatgtc

SEQ ID NO: 48282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcaggcgtccgctcctttgttggtcaggg

SEQ ID NO: 48283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcagtacagtaatttaccaaggcataccg

SEQ ID NO: 48284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcagtagtccactaggaggttcgcgcaca

SEQ ID NO: 48285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcatacatgacagcgtatcagtataatgt

SEQ ID NO: 48286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcatacgcgtgttctgggcttcgggtgtt

SEQ ID NO: 48287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcatcttggatactcagcacctctgcgtg

SEQ ID NO: 48288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcatgcgctggtagatgctgccaacaagc

SEQ ID NO: 48289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccaacaggagccagcattgttccgtaat

SEQ ID NO: 48290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccaatcggatgtacttggcaattccagc

SEQ ID NO: 48291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccaccattaagctcttatgcgtgcctgg

SEQ ID NO: 48292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccactctataagtgtgcgggtggtttgg

SEQ ID NO: 48293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccagaattctgagagcaactgccttgcg

SEQ ID NO: 48294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccagccatcaccgccgggaaagctacgg

SEQ ID NO: 48295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccataccggcaacgaattgctgtgcgtc

SEQ ID NO: 48296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcccatagacattcaaggaccggacaggt

SEQ ID NO: 48297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccccacgttggttgacacgttgtatttc

SEQ ID NO: 48298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccccggcatgtatagcctacgctcgctg

SEQ ID NO: 48299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcccggatgcatctgaagacgtgcacttg

SEQ ID NO: 48300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccctccacgaaagtttctcggtgtttaa

SEQ ID NO: 48301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcccttactacctgtgggccacttccact

SEQ ID NO: 48302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccgagatggtgttttgaagttgaaggtc

SEQ ID NO: 48303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccgcccgccattcatcgtgtacggtcgt

SEQ ID NO: 48304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccgcgattcgcgagtacgcgagggaggg

SEQ ID NO: 48305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccggacataatgctatttatccgcttcc

SEQ ID NO: 48306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccgggctaggcactccggtaaatgtgcg

SEQ ID NO: 48307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccggttgagggtatgttatgcctaccgc

SEQ ID NO: 48308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagccgtcattcagacatgagcctggaccac

SEQ ID NO: 48309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcctccctcttctttctaatctttcgggt

SEQ ID NO: 48310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcctcctcagacaaagtcttagttaagct

SEQ ID NO: 48311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcctcctgacaacacgatacgagctcccg

SEQ ID NO: 48312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcctgacttaccaagaggccgtgggaata

SEQ ID NO: 48313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcctggcagctgattgcctttctgccacg

SEQ ID NO: 48314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgaacacctagggacttcatgcgtgcca

SEQ ID NO: 48315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgaagaaaggctcgagttagcaccattg

SEQ ID NO: 48316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgaagtagcaaaacaataccagcgggat

SEQ ID NO: 48317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgaagtgatacaggactggttccgtcgt

SEQ ID NO: 48318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgaagttcccgttggcgaggctcgcagt

SEQ ID NO: 48319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgaatcaagcaaagcgggtagtctctat

SEQ ID NO: 48320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgacagtcagcgatgctcggcggcgagg

SEQ ID NO: 48321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgacgcgacgtcacttcattttaatgct

SEQ ID NO: 48322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgacgcgtgtgcatcctgcgctatcgat

SEQ ID NO: 48323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgagacaacagttggttgcgctgactgt

SEQ ID NO: 48324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgagcgtacgagcgcttccgatgttaca

SEQ ID NO: 48325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgagggcgagtcataaccggttgtttta

SEQ ID NO: 48326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgagtggcgtggaggttgccatgtctcg

SEQ ID NO: 48327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgatgcgagacccggaacagctcggcgg

SEQ ID NO: 48328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgatggttggaaggaggggggtgaagtg

SEQ ID NO: 48329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgccctcactattcacctcggctggtag

SEQ ID NO: 48330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgcgatttgatatgatgcggaatgtacg

SEQ ID NO: 48331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgcgtttccctccattgttatccgtcgt

SEQ ID NO: 48332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgctaacaagctctgggccggagcgtat

SEQ ID NO: 48333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgcttttgttactttgcctggcacgcct

SEQ ID NO: 48334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggaatggctgggcttgggcaaacagat

SEQ ID NO: 48335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggagacggatgacgacgtcgtagggac

SEQ ID NO: 48336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggagatcatgtcacctcagcgctgttc

SEQ ID NO: 48337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggcaagggcggaaacgttctgtgggcg

SEQ ID NO: 48338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggccttgggttctggaacagcgggccg

SEQ ID NO: 48339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgggatcagagccgcaatgatactcacg

SEQ ID NO: 48340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgggctttcatcaggggcaattacccta

SEQ ID NO: 48341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggggacgggacgtgggcgtgcgaacgg

SEQ ID NO: 48342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgggtcctgtgtactttgatgctgggta

SEQ ID NO: 48343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgggttaattacgatcaaggccgctatc

SEQ ID NO: 48344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggtcatacggccggattactttcgggt

SEQ ID NO: 48345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcggttctacaagttgcctaagacctcgg

SEQ ID NO: 48346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgtatgatcgcgggtttacggtgagaaa

SEQ ID NO: 48347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgtcaacatcgctctctacgtttcaacg

SEQ ID NO: 48348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgtgcgttagtattttccggacgagggg

SEQ ID NO: 48349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgtgtagccaggctagtatctgcagggt

SEQ ID NO: 48350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgtgtattttcatgggttggggctccta

SEQ ID NO: 48351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgtgtgatttgtatgacggtcataaacg

SEQ ID NO: 48352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgttagtcgaggcagacgttactgatgg

SEQ ID NO: 48353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgttcgaggccgtaaaagcgcgtgccgt

SEQ ID NO: 48354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgttcgagtgggtcccaggtccaggccc

SEQ ID NO: 48355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcgttttggctcgccattcaatttgtgcg

SEQ ID NO: 48356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctaaagcgctcttacagtaacggtcggg

SEQ ID NO: 48357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctaagaggcccgcgtgattttatcccgt

SEQ ID NO: 48358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctacaatatgctgatgacgcaggcgtta

SEQ ID NO: 48359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctacgaattctgtgagggtcatatcctg

SEQ ID NO: 48360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctatacagtcttagggtcctttgcagct

SEQ ID NO: 48361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctatgctttttcgacgcgatcatgcttt

SEQ ID NO: 48362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctcgcgacctcacagtcacttaacacct

SEQ ID NO: 48363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctcgcgtcacgtcatcaagtaagcgctg

SEQ ID NO: 48364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctgagagaacaccccgacattcctcgcg

SEQ ID NO: 48365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctgcaactatattcgctttgggcaagca

SEQ ID NO: 48366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctgcagcgtcgtcttggcatttccacgc

SEQ ID NO: 48367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctgcgtgcctaggacgggatacgtagtg

SEQ ID NO: 48368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctggatctcattcgtaaattattgaagg

SEQ ID NO: 48369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctggtccatgatgacgtatgatggctcg

SEQ ID NO: 48370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagctgtgatcataaagactgccgcaatcgc

SEQ ID NO: 48371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcttatgaatcgtgtaggactaacaattc

SEQ ID NO: 48372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagcttgactggcgctggttccaggttcatc

SEQ ID NO: 48373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaaaaagagaattatcctttcaactcgt

SEQ ID NO: 48374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaaactgtctggtcttttttgtggcttg

SEQ ID NO: 48375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaagtcgtacctgtcatagctggatctt

SEQ ID NO: 48376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaatgcgtggttaacaccctagaacggg

SEQ ID NO: 48377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacagtttgaatttcctattccctctta

SEQ ID NO: 48378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacccgaggctgcgaggaactaagcgat

SEQ ID NO: 48379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacctatgctgccagacgcttccatggt

SEQ ID NO: 48380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaccttccatcggatctcacatggctac

SEQ ID NO: 48381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacggaagcgttggtaggcgttacgcaa

SEQ ID NO: 48382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacgtcggcatactccggagcgccgcgt

SEQ ID NO: 48383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacgttaggcacggtggattcatttggg

SEQ ID NO: 48384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggactaagctgtgctctgcgcccgtactg

SEQ ID NO: 48385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggactgcaccgtcgcttcctattccattc

SEQ ID NO: 48386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggacttgacgtgatagcatacgggcaatt

SEQ ID NO: 48387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagaaaccgtacagtttcgtgcgcaaca

SEQ ID NO: 48388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagagatttacgttgacgtccactcccg

SEQ ID NO: 48389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagcatgaaagctcactcagaggtggca

SEQ ID NO: 48390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagcccgcgtggaatgacaattttcttt

SEQ ID NO: 48391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagccgcgtgaagggccggattcgtgag

SEQ ID NO: 48392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagcggaccacttcaaactgtatgagac

SEQ ID NO: 48393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggagcggtcaatgacggcacttgaccgag

SEQ ID NO: 48394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaggagattcacgcggttgtagattaag

SEQ ID NO: 48395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggaggcaacgcgcccgtggtttttgcccc

SEQ ID NO: 48396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggataggacattacgttcccgagtcatta

SEQ ID NO: 48397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggatcatcgttccccgcttaaccggtggg

SEQ ID NO: 48398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggatggcggcgaaattgtactgcgttggg

SEQ ID NO: 48399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggatggtattgcggaggatagtaatatct

SEQ ID NO: 48400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggatgtcgactacggaaccgggcaaagcg

SEQ ID NO: 48401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggattagtctcgggtatatccgagccacg

SEQ ID NO: 48402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcaactcgtagttaaacggcggagacga

SEQ ID NO: 48403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcaagtcgtcacaagtacgcgtggggag

SEQ ID NO: 48404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcacaaactgcactgttggctatgttgt

SEQ ID NO: 48405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcacgttgacaccggatggcttgcgcaa

SEQ ID NO: 48406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcagaggcaacactcgaatccgtgcggc

SEQ ID NO: 48407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcagataacaagccaggtcgttgtccct

SEQ ID NO: 48408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcagccgctttggtcccatgggggtggt

SEQ ID NO: 48409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcaggcgcataggggtaaggagtggacg

SEQ ID NO: 48410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcatgcatgctcccgactgatcgtctgt

SEQ ID NO: 48411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcattagggagtagattgaacgcggaac

SEQ ID NO: 48412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcattgtataaaatatcgggggtgcttt

SEQ ID NO: 48413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggccataagtcccgagtacagcggcgggc

SEQ ID NO: 48414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggccccttgattcatagcatcctagggca

SEQ ID NO: 48415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggccggagggagggcgtcgacgcatggct

SEQ ID NO: 48416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcctgcttaacggcgtcgatggtcatga

SEQ ID NO: 48417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgaaccctagtaagtggactgcccagc

SEQ ID NO: 48418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgaccgcagtgtgtgttcgtcgttacc

SEQ ID NO: 48419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgactaccgcactggtcctgtttaatt

SEQ ID NO: 48420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgagtcagctcatttcgtacggtatgt

SEQ ID NO: 48421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgatctgcgtacatgttcttggcggaa

SEQ ID NO: 48422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgcattttgattttcgcttcacgaccg

SEQ ID NO: 48423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgcttattttcctggtgtcttcgccgc

SEQ ID NO: 48424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcggcatgttagtccggctttactctta

SEQ ID NO: 48425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcggcggtggacggtctgctgcacgacg

SEQ ID NO: 48426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcggttattgtagtgctcttttaatgtt

SEQ ID NO: 48427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcgtccgttgctggtctactctcgagcc

SEQ ID NO: 48428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggctctcttcatgctatccctgataagga

SEQ ID NO: 48429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcttacctgtcccggcgaggccgtaggg

SEQ ID NO: 48430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggcttgctgcatgtgtgtggtcgagcgtg

SEQ ID NO: 48431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggaagcttgtcaattcccgtctggctta

SEQ ID NO: 48432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggaatccgggtgaggggggtctcgctcc

SEQ ID NO: 48433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggacgcgaatagtatggtatgatctggt

SEQ ID NO: 48434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggactggaagattcttcgatgtattgga

SEQ ID NO: 48435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggataagtacaattcaccgtatgtatta

SEQ ID NO: 48436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggatactgcacggaccatgctgtcacac

SEQ ID NO: 48437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggatggagggtggccgatgcatcatgct

SEQ ID NO: 48438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcacaccagtcttatatggttaggcga

SEQ ID NO: 48439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcaccgaggacgataaggctccagatc

SEQ ID NO: 48440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcctcatagcagtgagggagggggttc

SEQ ID NO: 48441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcgcagtttggccgaaggattggaagg

SEQ ID NO: 48442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcggcacaagcggccatgctattgtcc

SEQ ID NO: 48443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcgggatagaagcgtgataaacccgtt

SEQ ID NO: 48444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggcgtggtacgtcatcatagcatttctg

SEQ ID NO: 48445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggggaaaggactggtgcatgcggatgact

SEQ ID NO: 48446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggggcactgccgtcgtgaggccggtttgg

SEQ ID NO: 48447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggggcagtgtatgcgtcggcatacaggtt

SEQ ID NO: 48448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggggctccggtcgcgacggcagccgatcc

SEQ ID NO: 48449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggggtaggcgaaatccgtgaactataat

SEQ ID NO: 48450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggggtcgcggtgaagcgtcaaaactctga

SEQ ID NO: 48451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggtgacgtaggctcgtttacctaatggc

SEQ ID NO: 48452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggtgatccctgggagagagacgttgcgt

SEQ ID NO: 48453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggttgaacgcagtcccttggccagaggg

SEQ ID NO: 48454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagggttggatctggctctgcgctttgacgc

SEQ ID NO: 48455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtacgaaggcgatcgtttctttgtcagc

SEQ ID NO: 48456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtagtctgtagacgtgtacagctggatg

SEQ ID NO: 48457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtatattcgggggcatgatgcgcaacgg

SEQ ID NO: 48458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtcatggtggatcatgacggcatgtcac

SEQ ID NO: 48459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtcattccatgtcctgggggttaagtcg

SEQ ID NO: 48460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtccgctgcgtgttccgtcgggtagtat

SEQ ID NO: 48461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtcgaataggggtaactttccatactaa

SEQ ID NO: 48462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtcgctttcattgtgcgcgatgcttggg

SEQ ID NO: 48463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtctagaagggggatcgcagcttgacga

SEQ ID NO: 48464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtctgtgagagaccgcaatcgtcagcca

SEQ ID NO: 48465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtctttatcgtgcagaatcccggtcgag

SEQ ID NO: 48466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgcagatactgagatggttcggctcgt

SEQ ID NO: 48467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgcaggtatcttttgtcgtttcttgcg

SEQ ID NO: 48468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgccatctgtacaatgctcgagcttat

SEQ ID NO: 48469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgccgagtagactagcaatgtgacgtg

SEQ ID NO: 48470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgctggactggagtttgttcaacgcgc

SEQ ID NO: 48471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtggaatagtgttcccggttacagtggg

SEQ ID NO: 48472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtggaccgtaaggggattaagcgtgatg

SEQ ID NO: 48473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtggcggcgatatctagggtacacgata

SEQ ID NO: 48474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgggggtcgggtaaaatcgctcagtct

SEQ ID NO: 48475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtggtgttcagcacatgatcaacggctc

SEQ ID NO: 48476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgttatgggaagctagaaatctcaccg

SEQ ID NO: 48477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgttgcttcgtcgccacccgacgatat

SEQ ID NO: 48478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggtgtttttggttccggttgtgtgaatga

SEQ ID NO: 48479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggttaaatgcggggttcggtgccgggcgg

SEQ ID NO: 48480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggttaggtaaaatttacacatactctttt

SEQ ID NO: 48481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggttcgagtggtcgcggtggatttttgat

SEQ ID NO: 48482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggttgtccaagtgtgagatccgtgtacga

SEQ ID NO: 48483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggttttaccctaccagccagtcaccttgc

SEQ ID NO: 48484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggaggttttacgtaaccactgaacaatccctc

SEQ ID NO: 48485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaaccatcactttgtcgttgctttccca

SEQ ID NO: 48486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaaggccttccccattgccccaagcttt

SEQ ID NO: 48487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaaggcgccactaccaaacccggatcac

SEQ ID NO: 48488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaagtgtgaccacgaacgactttacacc

SEQ ID NO: 48489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtacacgagtcgaacacgtccctcttaga

SEQ ID NO: 48490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaccaggttcttatatcccgactcttcg

SEQ ID NO: 48491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaccatactgcgatactgagcgcttcac

SEQ ID NO: 48492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaccatttgagcaggttgcgcggacctg

SEQ ID NO: 48493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtacggattgcagctgcatcgttacgttt

SEQ ID NO: 48494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtactaaactagccagtaattcggtagct

SEQ ID NO: 48495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtagctgagtcagtttacgcgtcacaggt

SEQ ID NO: 48496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtaggtggagctcgtatctgcacgggtgg

SEQ ID NO: 48497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtagtggtgtcttgcaggcttttctagtc

SEQ ID NO: 48498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtatgcgaaccagttttccctaggtccgt

SEQ ID NO: 48499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtattcttagcttggcaacgcaccctgca

SEQ ID NO: 48500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtcaaggggtggtccctgttaacattttt

SEQ ID NO: 48501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtcaatgattggactgtgttgttagtgca

SEQ ID NO: 48502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtcacgtgtgcgttgctggctggcgggga

SEQ ID NO: 48503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtcaggcggatctagcatgcggtcaaacc

SEQ ID NO: 48504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtccgacaatgggatattgcgcgcggacg

SEQ ID NO: 48505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtccgggaaggctcgatggtgctggtggg

SEQ ID NO: 48506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtcgcttccacgtagtgtcgactcttccg

SEQ ID NO: 48507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtctcacactatgtgctgggcccaccttt

SEQ ID NO: 48508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtcttgctaacaccgggacctgtgggtct

SEQ ID NO: 48509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgaagcgccaagcctaggtccagcctgt

SEQ ID NO: 48510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgaaggaggactagctgagtttatgaag

SEQ ID NO: 48511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgacagaattcactgtaatcctggaggg

SEQ ID NO: 48512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgagcgccagtggatctgccgtttggcg

SEQ ID NO: 48513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgatgacagcttgcgactctgttcggtc

SEQ ID NO: 48514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgcaacaagagtgccaccgctattcacg

SEQ ID NO: 48515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgcagacgaagaacgcagtcgaacctac

SEQ ID NO: 48516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgcagctgatcgtgagggtatagggcga

SEQ ID NO: 48517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgcaggttcactcatgccaccgtcgagc

SEQ ID NO: 48518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgccatggtctggcgaagtatcatggtt

SEQ ID NO: 48519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgccggcatgccaggggagttagttacc

SEQ ID NO: 48520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgccgtgctagtgcccgctatggcgtgt

SEQ ID NO: 48521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgcggcggagtgtcagctcacttcgttt

SEQ ID NO: 48522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgcgtttctaccgcgtgaacggggagtg

SEQ ID NO: 48523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgctatggttcgagggagatcacgtttt

SEQ ID NO: 48524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgctgtcaggtccctggaaaaaatcggt

SEQ ID NO: 48525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtggcacggtctatgcgtacctagtagag

SEQ ID NO: 48526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtggcatgatcaaacgctacctggttcga

SEQ ID NO: 48527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtggcctcgccagtaactccacttcgtgt

SEQ ID NO: 48528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgggaatcaagtgggcattacccggtcg

SEQ ID NO: 48529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgggctagttaggttcctcgagagtggt

SEQ ID NO: 48530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtggggctccgtgtggtctcttacgacat

SEQ ID NO: 48531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgggggcctgatactcgaagagttgggg

SEQ ID NO: 48532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgggtatcgctacagcacagcgttcctc

SEQ ID NO: 48533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgggtgtctttcccatgctgcgagttct

SEQ ID NO: 48534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtggtttggcatgtacatctcggttgtct

SEQ ID NO: 48535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgtcggagatgggctcattactctcctt

SEQ ID NO: 48536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtgtttccgtgtacgctttggaccatgtg

SEQ ID NO: 48537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttcaagacaggttagagcatggcattgg

SEQ ID NO: 48538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttcaaggacatgcacccagaatatgttg

SEQ ID NO: 48539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttcacaaggatgtgcgggacgatacggg

SEQ ID NO: 48540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttcgatgcagcggtaggtgtttaggcac

SEQ ID NO: 48541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttcggctgcgtatacgcgacgtgcgatt

SEQ ID NO: 48542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttcgggacatgaaccaagaggacgccgc

SEQ ID NO: 48543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttgaatccctctttttacctcgacacgc

SEQ ID NO: 48544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttggcttacgggaccgaccgggtgtcat

SEQ ID NO: 48545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtttagtgcactgccgatatatcacgggt

SEQ ID NO: 48546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtttgatacaggcgcaaccagtcccggtc

SEQ ID NO: 48547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagtttggccagggaggcttggtggttatgt

SEQ ID NO: 48548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggagttttattcagcccaattcccggatccgt

SEQ ID NO: 48549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataaatttgcaaggacattcagcatcatgt

SEQ ID NO: 48550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataacagctctggtagaacggtgatcactc

SEQ ID NO: 48551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataagaacatctgggacaagggacgcgcct

SEQ ID NO: 48552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataagaagcacagaagtccccccggcatgt

SEQ ID NO: 48553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataagcatacgtgagacaggttttggccgg

SEQ ID NO: 48554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataagctgttcttggccgaatgtatcttgt

SEQ ID NO: 48555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataaggcgttgaggcctggtctcggggtgc

SEQ ID NO: 48556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataatactatcttactgtcaaccgggttgc

SEQ ID NO: 48557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataatatgtttttattggagagtagcatag

SEQ ID NO: 48558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataatggagctagtacggtggatttggcgt

SEQ ID NO: 48559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataattggtccgtcgggccgtttatggcat

SEQ ID NO: 48560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacaaagctacttacccgtcgggcctctg

SEQ ID NO: 48561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacacgacgcggagtatgggaccgggcat

SEQ ID NO: 48562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacacgcaagtgatttaactgaaagggcg

SEQ ID NO: 48563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacatgattaccggtctctcctcatcttg

SEQ ID NO: 48564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacattcaagagggcagctaacgctagaa

SEQ ID NO: 48565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataccatacatgttctctaacgggttgtat

SEQ ID NO: 48566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataccgagcggctcctgggatcattgccct

SEQ ID NO: 48567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataccgtaacctcggagggtacttttggat

SEQ ID NO: 48568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacgaaaatatcttaacgagggaaatgtg

SEQ ID NO: 48569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacgggtagtatgcttctagtgtgctggt

SEQ ID NO: 48570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacggtcagaattaacattagaacctcgg

SEQ ID NO: 48571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacggtgcacagtgggaaacaggggacgg

SEQ ID NO: 48572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacgtccgcgttttccgtcctgtctcatc

SEQ ID NO: 48573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatactcctgtacgtctggtccggctatcgc

SEQ ID NO: 48574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatactgtcaggggttgcatgggtggccgat

SEQ ID NO: 48575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatacttgatcttcagtggctgtcctctagc

SEQ ID NO: 48576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagacttttactggtagcaaccgtagctc

SEQ ID NO: 48577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagaggcgaaaggcgctcccagcaaaggg

SEQ ID NO: 48578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagatgtgacagagggcggtagaccttcg

SEQ ID NO: 48579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagcactcggacctgtttagaactcacgt

SEQ ID NO: 48580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagcagcgaatcaaaatccttcatcgggt

SEQ ID NO: 48581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagcattcaatatttttggtatcatatct

SEQ ID NO: 48582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagccatatctcaccctgacccgtgtgtt

SEQ ID NO: 48583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagccgactagaacggtttttaataaggg

SEQ ID NO: 48584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagcgctcctggtctgctctggcacggta

SEQ ID NO: 48585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagcgctgtgcatcaatcgcagcgttgga

SEQ ID NO: 48586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagcgtctggaatcatctagagccgctct

SEQ ID NO: 48587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggataggaaagataggtaacgtgcgtggcccg

SEQ ID NO: 48588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagtcaatctttcgaccacgtacaatact

SEQ ID NO: 48589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagtgcgatcgtggcgagttgttagcgct

SEQ ID NO: 48590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatagttgccggttatgccagttgctcctcg

SEQ ID NO: 48591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatcacacttgacgatgcatcgtgcaatt

SEQ ID NO: 48592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatcactactacatgctgatttggtccgg

SEQ ID NO: 48593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatcggagaaggtggtttctaggacgtct

SEQ ID NO: 48594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatcggataggctcgggtcgtcgttggtg

SEQ ID NO: 48595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatctccaatagcttgcgagacggagcat

SEQ ID NO: 48596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatgctacttcgacggatgaggctttcgt

SEQ ID NO: 48597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatgctgttccatgtacccgtcttggact

SEQ ID NO: 48598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatatggatcgaaggtgagtttggtgcaatg

SEQ ID NO: 48599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatattactttaattcagctgacgcccacct

SEQ ID NO: 48600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatattcttatgcggtgtgtggacccttagc

SEQ ID NO: 48601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatattgacgtccgaagcagtacttcagtgg

SEQ ID NO: 48602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaaaacagcaccgaccatagtctccgcc

SEQ ID NO: 48603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaaccaatgtgaaatactgatatttggg

SEQ ID NO: 48604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaactggaatggtcacaaccttggtgtg

SEQ ID NO: 48605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaagcggtcattatttaggtcgcgatag

SEQ ID NO: 48606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaagctcgcctagcgcagaccgtgtttc

SEQ ID NO: 48607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaaggggaagcactaaattgacgcgatg

SEQ ID NO: 48608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcacagccacacgcggtattatgtcaaga

SEQ ID NO: 48609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcacaggttccacgaacattaccgggccg

SEQ ID NO: 48610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcacatgcctcgtaatcgaattgcgttgt

SEQ ID NO: 48611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcacgcctgctggccatcgtcggtcctgg

SEQ ID NO: 48612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcacgggatagacagccctattcatctaa

SEQ ID NO: 48613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcagagtttgtgtttctagggggatggat

SEQ ID NO: 48614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcagctatattttgtcttctgtgtgaaga

SEQ ID NO: 48615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcaggacgatactgatatcgagggcggcc

SEQ ID NO: 48616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcagtaccgtactaggtggagtaaaacaa

SEQ ID NO: 48617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcagtactctgtgtataatgcagatgtga

SEQ ID NO: 48618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcatacagtacgactgctcggcctcgtat

SEQ ID NO: 48619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcatcatggtagttgaggttttagcgcgt

SEQ ID NO: 48620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcatcggtgggtatgttacactcttatct

SEQ ID NO: 48621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcatcgtgtagggattattagtagggtca

SEQ ID NO: 48622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcatgtggtcccggcctcagtgttgggac

SEQ ID NO: 48623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcatgttgtaaacagacggattcgatccg

SEQ ID NO: 48624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcattctttctcggtttattcctgtggct

SEQ ID NO: 48625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcattgatacgcttaaacagcggcacggt

SEQ ID NO: 48626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcattgtcgcctgtcctatgttgcaacga

SEQ ID NO: 48627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccacccaatctatgcgaggtagcgtagt

SEQ ID NO: 48628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccacgcggttgtatgagtgacaatgtgg

SEQ ID NO: 48629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccagcttcgtctttaccgcgttcagggg

SEQ ID NO: 48630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccaggtcttgtttgccaccttaagaatc

SEQ ID NO: 48631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccataaatcatgcacgtcactacgcgtt

SEQ ID NO: 48632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcccagggcaaggccggctaagtggctta

SEQ ID NO: 48633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcccatgctagacacttaagcttaatgga

SEQ ID NO: 48634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccccgtgccgaagaggttttcatgttcg

SEQ ID NO: 48635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcccggccgtcggtgaggtgcattatcgg

SEQ ID NO: 48636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcccggccttcatctgctgtgcgtattcc

SEQ ID NO: 48637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcccttatgaccgagtaaccaaccgcact

SEQ ID NO: 48638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccgaaaaggtatgaccggtctggagttg

SEQ ID NO: 48639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccgatggcttttgcggatttctccacgg

SEQ ID NO: 48640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccggtaagtgctaacagtgcttgatcgc

SEQ ID NO: 48641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccgtgcacccgtatcacgcgactatagc

SEQ ID NO: 48642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcctacgccatggcacgctgattgcggat

SEQ ID NO: 48643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcctgacgtaatcgcagcttgttcatgga

SEQ ID NO: 48644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcctgcgcggggatagttttggagtcgct

SEQ ID NO: 48645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatccttggcattactggccttcaccggctc

SEQ ID NO: 48646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgcaagcttcttcgaagagcagggggcc

SEQ ID NO: 48647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgcagtaaaaagagatgggcacgtacta

SEQ ID NO: 48648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgcagtataatgtcacaccatcctgtac

SEQ ID NO: 48649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgcccgggttacaggtgttttgtgactt

SEQ ID NO: 48650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgcccggtgagcttgcggatttgtcaat

SEQ ID NO: 48651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgctagtcttttgtttttaaacctttcc

SEQ ID NO: 48652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgctgagcgatgatgccgggttttgtgt

SEQ ID NO: 48653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgcttctgttggaatgacaaatctccgg

SEQ ID NO: 48654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcggacgccagcaagaagatgcttagttc

SEQ ID NO: 48655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcggcattacctgtacgtgggaaattacg

SEQ ID NO: 48656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcggccaaaagtgatcgagcaactaggga

SEQ ID NO: 48657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcggcctttttcgccgacgccatgccggc

SEQ ID NO: 48658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgggccaattacgtccttgtctcacctc

SEQ ID NO: 48659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgggcccgtttgtcccaggatttccgtg

SEQ ID NO: 48660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgggtactgttctgtcagacgtctttgc

SEQ ID NO: 48661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcggtgtcgcctctgagactgctcgcagt

SEQ ID NO: 48662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgtaggccgtagatgcgccgggctatcg

SEQ ID NO: 48663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgtcgattgatgctccttactactgtcc

SEQ ID NO: 48664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgtcggaccgttgctcgagtggcaccgg

SEQ ID NO: 48665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgtgcattaagtctggctttagggttag

SEQ ID NO: 48666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgtgccctggcacagctgcgcgggacat

SEQ ID NO: 48667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcgttccgtctcggattagtaacgacccg

SEQ ID NO: 48668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctaaggcaggcagcgggcacgaacgtgg

SEQ ID NO: 48669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctagattacgaggttgcttatgcaacac

SEQ ID NO: 48670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctagctgcatatgttctgaattgtcgag

SEQ ID NO: 48671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctaggaaccggccacagacgcagatggc

SEQ ID NO: 48672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctagggactaacgggactagagttgtac

SEQ ID NO: 48673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctagggttcaattgcactaagcctgagt

SEQ ID NO: 48674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctcagtagaactcatatcaacacaaccg

SEQ ID NO: 48675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctcggcccgcacactcgtataaccgtgc

SEQ ID NO: 48676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctcggtgatttcgatcgatgtcagctta

SEQ ID NO: 48677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctggccgtctcctttgcaagttcgttca

SEQ ID NO: 48678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctgggagtccacgaaggcatttggattc

SEQ ID NO: 48679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctggggttacccgtggtcatattggccc

SEQ ID NO: 48680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctggtccagggagctttaccgaggcttc

SEQ ID NO: 48681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctgtcatccaatggaacttggtgctctc

SEQ ID NO: 48682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctgtgacgcgccttatcgacgctcccga

SEQ ID NO: 48683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctgttaacattcgttcatgccaggatcg

SEQ ID NO: 48684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcttatcattttgtatgtttcactcatgg

SEQ ID NO: 48685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcttcatactgccttgctcttctggtcgg

SEQ ID NO: 48686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatcttggctctagaggttgcagtctgcttc

SEQ ID NO: 48687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatctttcacaaggaatgcgttacgtttttc

SEQ ID NO: 48688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaacccttgtgcattggaatgttagacc

SEQ ID NO: 48689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaacggtcatatatgcgtgcccttgttg

SEQ ID NO: 48690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaagacaaggccgtcaccgcagcattag

SEQ ID NO: 48691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaagcatatgtggtggaagtatcggccg

SEQ ID NO: 48692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaagccttaacatcaacgtgtgctttac

SEQ ID NO: 48693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaagtcagccagaccccctcagcgcttt

SEQ ID NO: 48694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacacaaaatttgataggtggggacttt

SEQ ID NO: 48695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacattcgtcggaggacgtacccagcgt

SEQ ID NO: 48696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacgccacgcagaagagcgctctggttg

SEQ ID NO: 48697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacgtagtaattcgggcgaacgacggac

SEQ ID NO: 48698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacgttcccgcccaaaccatcaccgtgt

SEQ ID NO: 48699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacttacctccctgcatgttatctaatc

SEQ ID NO: 48700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgacttgtctatgtccagggttgacaaac

SEQ ID NO: 48701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgagaggagcgagattcggttcgatgttt

SEQ ID NO: 48702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaggatagatgggagattggcctccgcc

SEQ ID NO: 48703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgaggtccaggaccggattcaggggatta

SEQ ID NO: 48704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgagtaacgggtaacagtccgccctgctg

SEQ ID NO: 48705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgagtactgagcttctcgctgcgcttttt

SEQ ID NO: 48706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgagtgggccatcgactcttctgcaacgt

SEQ ID NO: 48707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgagtgttcccgcatgttcccgtggcctg

SEQ ID NO: 48708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgatccgtttcgttttaattactccttat

SEQ ID NO: 48709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgatggcgagttcagggagagcaacgcgt

SEQ ID NO: 48710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgatgtatcgtgtcgcttagttaacattg

SEQ ID NO: 48711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgatttgaacacatgtccgctctgcgccc

SEQ ID NO: 48712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcacagagtggacgtcagaatgtgtcgc

SEQ ID NO: 48713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcaccgtgtagcactagcgtcgcgaccc

SEQ ID NO: 48714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcacctagctcaacacactacacggtac

SEQ ID NO: 48715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcacgaagtgatccatgtgtgccaattg

SEQ ID NO: 48716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcacgcataggcgcactaggatattgct

SEQ ID NO: 48717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcagctttcacttggactatagctaggc

SEQ ID NO: 48718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcatcgatatattgtagtgcttaaaaaa

SEQ ID NO: 48719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcatgtctagctgtgtgctgtgtccagg

SEQ ID NO: 48720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgccaggatgtttccgattcctttagagc

SEQ ID NO: 48721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgccattactgtcgtcgctgaattgcatg

SEQ ID NO: 48722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgccgattgactagcctgctcgttcgcgt

SEQ ID NO: 48723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgccggctaaagcgttcctgtctgtaggt

SEQ ID NO: 48724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcctcgttagattttagcccagaagtca

SEQ ID NO: 48725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgaacactaggattcaatagaattaca

SEQ ID NO: 48726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgaattctctcagtaagattatgggta

SEQ ID NO: 48727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgacgcacttaggcagtcgcaatgcgc

SEQ ID NO: 48728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgagatgtatgacgagggttcctcggg

SEQ ID NO: 48729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgcaggcttcacttggtggggtgttag

SEQ ID NO: 48730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgctgatgagtttttggaagtgacagt

SEQ ID NO: 48731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcggcggctcgtaccaacgtgatcagct

SEQ ID NO: 48732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgggcattgcgggcctgtcgggaaagg

SEQ ID NO: 48733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgggtctgtttcaagcatctttgcact

SEQ ID NO: 48734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcgttgtttacacctctgttgcgcactc

SEQ ID NO: 48735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgctatccgggttgtcgtaaacgcggggg

SEQ ID NO: 48736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgctgagcgtcttatactttcgtatatcc

SEQ ID NO: 48737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgctgcggggcatactcgtaatacctttt

SEQ ID NO: 48738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgctgtagattacggaaagtgtacgcgcc

SEQ ID NO: 48739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcttagggcttgcgaaggtggttaatgg

SEQ ID NO: 48740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgcttggaatcattgctgtccttctctcc

SEQ ID NO: 48741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgctttattccctgccatcgccctcctcg

SEQ ID NO: 48742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggaaagctactgtacacctcggggggtc

SEQ ID NO: 48743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggacatttccttggtttaacacaggtgc

SEQ ID NO: 48744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggacgtccaatagggctgcgttcgtcgg

SEQ ID NO: 48745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggataagcagaccagatcactcggcccg

SEQ ID NO: 48746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggcacgcggtgatgagatgatgtatggg

SEQ ID NO: 48747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggcgaaggggcggtgaagcgtgtcctgt

SEQ ID NO: 48748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggcgacgctatatacatcatgtgggtta

SEQ ID NO: 48749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggcggcggctgcgctcatacactgcttt

SEQ ID NO: 48750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggcggctcggcaccggaattgtgcttgg

SEQ ID NO: 48751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggaggggtttattgcattaagcctgat

SEQ ID NO: 48752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggcactttcggaccttctccattcagc

SEQ ID NO: 48753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggccaataccaggctccagatacgaga

SEQ ID NO: 48754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggcctaatgaactgtggccttttcctg

SEQ ID NO: 48755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggctcgattcacacggagcatcggcgc

SEQ ID NO: 48756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggggacggcgcacctgctaattcttggc

SEQ ID NO: 48757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggggatgcggccgttacatctgcaatct

SEQ ID NO: 48758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggggccgagttcaagcttggaaatgaac

SEQ ID NO: 48759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggggccatacattctattccagaccat

SEQ ID NO: 48760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggggttacggggaaattctgagatcccg

SEQ ID NO: 48761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgggtgactttggttacatcagtctcgac

SEQ ID NO: 48762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtaggtctagcgggcgactactttacc

SEQ ID NO: 48763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtattataataccgtgacggttgagat

SEQ ID NO: 48764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtcacacgtctagggaggtgcactctg

SEQ ID NO: 48765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtcccggaaacgagtctatccgttgcg

SEQ ID NO: 48766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtgcgcttcgaggattgttcgcacgtg

SEQ ID NO: 48767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtggcacgtgtgtccaagtagggccgt

SEQ ID NO: 48768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtggcccggatatcgttgtgatcgttc

SEQ ID NO: 48769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggttatgattgccgttaaccgtttagtc

SEQ ID NO: 48770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatggtttgggaaatgagacgcaacagaaag

SEQ ID NO: 48771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtaggtgctcactgtcgtaaggatcccc

SEQ ID NO: 48772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtcccctgaagtcaactagtcctccgtg

SEQ ID NO: 48773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtccgagctgtcaccttgttatgtttga

SEQ ID NO: 48774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtccggtacttcatcgggcgcagatgcc

SEQ ID NO: 48775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtcgcctcggtagtatcgatcggtgggg

SEQ ID NO: 48776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtcggatagtgggcgtaaacaccatccc

SEQ ID NO: 48777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtgcactaacccgaggataatcggcggt

SEQ ID NO: 48778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtgcggcgtaagtctgatggggttcctg

SEQ ID NO: 48779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtgcttttaatgaataactgtgcatgct

SEQ ID NO: 48780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtggattaagtcacgacgcagcaatcga

SEQ ID NO: 48781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtggcccagtgctgcctaatctgtccac

SEQ ID NO: 48782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtgttcccgttacatcatgtacagcgcg

SEQ ID NO: 48783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgttcgcgcgaccgggttctatatcgttg

SEQ ID NO: 48784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgttggacggacagtgtacaagggggagt

SEQ ID NO: 48785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgttgtgcggctcgcaacggtgacacttc

SEQ ID NO: 48786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatgtttgctatgaggacgagtagattaggt

SEQ ID NO: 48787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattaaatctgaaggttgtgaggatttaggt

SEQ ID NO: 48788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattaacctcggttcgtacttttgcccgaaa

SEQ ID NO: 48789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattaagcaggtgtctggatcagttttaggt

SEQ ID NO: 48790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattaagcataattcggcgggtctagcccgg

SEQ ID NO: 48791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattaagccgcccattacagaggcgaaggcg

SEQ ID NO: 48792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattacaacacgagggcatcaaggatgtctg

SEQ ID NO: 48793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattacagggacgcatgaagtgtcgaagcgg

SEQ ID NO: 48794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattacgcccagtctatagtactgctgtatc

SEQ ID NO: 48795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattactgacgattcataccgttgggcttgt

SEQ ID NO: 48796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattagaaacgtcggaaaatattgggactgc

SEQ ID NO: 48797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattagaccagtctacaaccgtctgcaccgg

SEQ ID NO: 48798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattagaccgtcaggactggcactgcatcct

SEQ ID NO: 48799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattagggagaacgggtcaacagcgattctt

SEQ ID NO: 48800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattaggtttgctttttgagcagccgcttgc

SEQ ID NO: 48801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattagtgtctcggtatgttctccgaaattg

SEQ ID NO: 48802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattagttctgccgcttactcatgaatggta

SEQ ID NO: 48803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattatcttttttctatcgtccgttattgcc

SEQ ID NO: 48804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcaaccgggggtcctttatgccgagtcg

SEQ ID NO: 48805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcagccgcccaacgagtgccaagctctt

SEQ ID NO: 48806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattccatggagtctgcaagacaatatgtgg

SEQ ID NO: 48807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgaactgcctctgagcatcaggcgtac

SEQ ID NO: 48808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgaattccttgcttggggattaatagc

SEQ ID NO: 48809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgatcaccgtgggtagcacttagtctc

SEQ ID NO: 48810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcggcgcgaggcgaatttggaggtgggg

SEQ ID NO: 48811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgggatattcaagctatatctagagtc

SEQ ID NO: 48812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgggccatccaggtgggctctgtacga

SEQ ID NO: 48813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgtgcgactcggggttgacagccttcg

SEQ ID NO: 48814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgtgctatcggtattcgtgcgctctgt

SEQ ID NO: 48815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcgttggtgacgggcttatgcgtctcgc

SEQ ID NO: 48816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattcttgtcggagtttaacttgggtaatct

SEQ ID NO: 48817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgaagcgctattcgttatcgttaggaat

SEQ ID NO: 48818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgacggtcacaggctcttttgactccgc

SEQ ID NO: 48819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgatacttggtgttagccgcagttttgt

SEQ ID NO: 48820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgatcggcgggttctggggtgttatatt

SEQ ID NO: 48821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgattaacgtttagtttggggaatgcac

SEQ ID NO: 48822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgcagggccgattcggacggtatgggta

SEQ ID NO: 48823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgcatgcaatcgatgagcccctcttgtt

SEQ ID NO: 48824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgcctgatatgtgcgttaagtgttttac

SEQ ID NO: 48825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgcgagaatatcgcgtcgagtatgaacg

SEQ ID NO: 48826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgcgcaacattttggccctttgttccat

SEQ ID NO: 48827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggactggttggtaaatgcgcgcgttta

SEQ ID NO: 48828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggcaccgaaggagacagatgttgagtt

SEQ ID NO: 48829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggggaacagtaccatgacctgagatcg

SEQ ID NO: 48830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggtggatacgcctgagcgcaattcacc

SEQ ID NO: 48831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggtggggttttcgtgcttgtgcgttca

SEQ ID NO: 48832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggtgttactcgtttgttacacagaacg

SEQ ID NO: 48833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattggttacggaggagcacggtcttatccg

SEQ ID NO: 48834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgtatattaggcatattgctcatggaca

SEQ ID NO: 48835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgtccgtaagctcgccatactaatcagg

SEQ ID NO: 48836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgtgtcgtctggtgttttggatcgtgta

SEQ ID NO: 48837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgttcactgcttcaccgtgtgaccgcta

SEQ ID NO: 48838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgttcatcgccattccgtaagggaacgg

SEQ ID NO: 48839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgttcctagtatgtctacgtattcccgg

SEQ ID NO: 48840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgttcgtatgcttgacaccatggcctag

SEQ ID NO: 48841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgttggcagcatcttccacaggggatcc

SEQ ID NO: 48842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattgtttgtaaaagtatgccgttcgctaaa

SEQ ID NO: 48843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttactatgctgaccaaactgaccattgg

SEQ ID NO: 48844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttcactcgggtacgctgagtgaggtgga

SEQ ID NO: 48845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttcagagtaccgactgtaggagcctggc

SEQ ID NO: 48846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttcgagcgtttccggtaagtttttagtg

SEQ ID NO: 48847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttcgtactcaattagtccggaggttctt

SEQ ID NO: 48848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttctatcatagcggtgcttgagactaat

SEQ ID NO: 48849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttctcggcaatttcggacttccgcttga

SEQ ID NO: 48850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttgccgacctattaactaaagacttatt

SEQ ID NO: 48851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttgctgacgttaattcaagcgcggaact

SEQ ID NO: 48852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttggcgacagccctgtctgcagtcatgc

SEQ ID NO: 48853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttggtgaagggaaggaagtggacatgca

SEQ ID NO: 48854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttgtaacttcgcctcactcccgggcacg

SEQ ID NO: 48855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggatttgtagtaagttctatgtacacttatga

SEQ ID NO: 48856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattttacggtaagcgaacaacaggtttcac

SEQ ID NO: 48857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggattttctcgctaggggccggagaaacggat

SEQ ID NO: 48858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaaaggtggttgcagcgatttgtatgcc

SEQ ID NO: 48859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaacggcattgcttctccccgttcctcc

SEQ ID NO: 48860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaagagcgcgttatttcctagcgtatgt

SEQ ID NO: 48861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaaggaatttgttctcctggtaggccta

SEQ ID NO: 48862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaagggggctggttgggctttgtttggg

SEQ ID NO: 48863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaacagggcggtcgaacgggcgtactttg

SEQ ID NO: 48864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaacattttctcttcgtgctgagctgtgc

SEQ ID NO: 48865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaccccacgtatattggttcacctacgt

SEQ ID NO: 48866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaccgagcattttgatccgttaagttag

SEQ ID NO: 48867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaacctctaacaagactgtgcctcgcccc

SEQ ID NO: 48868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaacgaccgagctttcatagtgcgatagt

SEQ ID NO: 48869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaacggtacgaacagtcaattcgaagggt

SEQ ID NO: 48870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaacgtcactgcgcaatctcgctcatatc

SEQ ID NO: 48871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaactacaactgtcacataggaatttatc

SEQ ID NO: 48872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagaaatcacctgatcacgcttgtcgag

SEQ ID NO: 48873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagaacaagcgcagggaccagatgtggt

SEQ ID NO: 48874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagatgcttccagttatctcaatccgag

SEQ ID NO: 48875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagcactagtcaatacctctcttccaca

SEQ ID NO: 48876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagctcagtatattacggttatgcatcc

SEQ ID NO: 48877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagctgaaaggcgcggaacctaggttcg

SEQ ID NO: 48878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaagcttctcttagcagggggtttcggga

SEQ ID NO: 48879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaggaagtgtcttcttgtaccagacgtc

SEQ ID NO: 48880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaggaggtgcaggatacgggggtgtgtg

SEQ ID NO: 48881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaaggattctgtccaaccagatccgtggg

SEQ ID NO: 48882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaatacaagggtttccatcctaggcaatt

SEQ ID NO: 48883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaatacgggcgcctttatgtggtaacggc

SEQ ID NO: 48884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaattgaaccaggtatgcggtttgactcg

SEQ ID NO: 48885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacaaacgcggcataggcgcgccatggac

SEQ ID NO: 48886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacaaagaagatacatgaatcaggcatta

SEQ ID NO: 48887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacacgcgcgctctattagctagtctcgc

SEQ ID NO: 48888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacacttggaaataccgtctgggcgttag

SEQ ID NO: 48889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacagatagcgaaatctctggtgtgttac

SEQ ID NO: 48890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacaggcggtgatggctgtttaggtattt

SEQ ID NO: 48891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacaggtgcgtgtctccggttgcttcggt

SEQ ID NO: 48892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacagtggtggcgaattagggcgttcgtt

SEQ ID NO: 48893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacatgcacattccccaggcgtccttgcg

SEQ ID NO: 48894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacccctaacaatttcaaataccctcgga

SEQ ID NO: 48895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaccctcaatccggtgctgacgagtatgt

SEQ ID NO: 48896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaccgtgatttaccccacggcagagataa

SEQ ID NO: 48897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacgagcagaatcgataacgtattgagca

SEQ ID NO: 48898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacgaggtgcacactccactcatcggcgg

SEQ ID NO: 48899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacgcggggtgtggcgcaaaacagccgat

SEQ ID NO: 48900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacgcggttggtgtttcacgaggcgacct

SEQ ID NO: 48901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacgggcgagtgttcgacgtttgttgagc

SEQ ID NO: 48902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacggggtagcaaagtgatgaatgaggca

SEQ ID NO: 48903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacggtcatgggagtataggggaactgcg

SEQ ID NO: 48904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaacgtccatccgaccactaggactgcagc

SEQ ID NO: 48905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaactcaacgtcgcaccgttacttagtcgc

SEQ ID NO: 48906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaactcagacgaacgttgggcttggattcc

SEQ ID NO: 48907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaactccgatttggcggatttttttcgtgt

SEQ ID NO: 48908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaactggaggaccattaccaatcattggac

SEQ ID NO: 48909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaactgtcgccggttattctgaacgtcaac

SEQ ID NO: 48910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagaacggtggcaaggcggcatggggcgg

SEQ ID NO: 48911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagagaatgcatacggtttcggtagactt

SEQ ID NO: 48912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagagccatacactgacattttctttttg

SEQ ID NO: 48913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagaggatcgggggcttgcggaacaggtg

SEQ ID NO: 48914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagagggattagctccttgacgtcgttaa

SEQ ID NO: 48915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagataatttctgttccactatgtttccc

SEQ ID NO: 48916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagatggctcagtcccgcgttgggagcac

SEQ ID NO: 48917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcaagttcacactagtactcagtgccg

SEQ ID NO: 48918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcaccacaaggttgcgtgtattcggtt

SEQ ID NO: 48919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcacgacggtcatgagccaatcctcct

SEQ ID NO: 48920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcactaggttcgttggtctgtctgatg

SEQ ID NO: 48921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcagatcggaccgtaatatagaccgac

SEQ ID NO: 48922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagccgggtcatcgtgataaatggtcacg

SEQ ID NO: 48923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagccggtcatgaccgcgtacgcctgatc

SEQ ID NO: 48924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagccgtagtccaggtgttgacaagattc

SEQ ID NO: 48925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagctgttgacctcctctcgtgcacaggg

SEQ ID NO: 48926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcttcctacagcctgttcgaaccgtta

SEQ ID NO: 48927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagcttgcaaccactatgttaggcgacgc

SEQ ID NO: 48928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaggaaaggattctgggtttactggattg

SEQ ID NO: 48929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaggacggcagttcttcccgcaggcgacg

SEQ ID NO: 48930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaggattgcactgatgtgacccgccacgc

SEQ ID NO: 48931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagggagattaggctcgtttgtgaggcgt

SEQ ID NO: 48932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagggagtgggttgcaccggcttttccgt

SEQ ID NO: 48933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaggtctctctgatccagtcgtttatttt

SEQ ID NO: 48934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaggtgcctgctggcataatgatctaggc

SEQ ID NO: 48935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaaggtgtgccgtgcagttcgacgatggtg

SEQ ID NO: 48936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtagcgacacactggaatgttacgcca

SEQ ID NO: 48937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtcaggaccgactctggtggaccgtat

SEQ ID NO: 48938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtcgaatatttggaccttggttaccct

SEQ ID NO: 48939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtctaatccttttgttaggcggtgcaa

SEQ ID NO: 48940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtctgttagcgcctctgcagtattggg

SEQ ID NO: 48941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtggactgcggtagacctgtagctggg

SEQ ID NO: 48942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtggctatttatcggggtaatccgcgg

SEQ ID NO: 48943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtgtggggaatgggttaacgagttagc

SEQ ID NO: 48944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaagtgtggtccttgtctgggttatgtacg

SEQ ID NO: 48945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaataaacgcgcatgaccctcggtcgattc

SEQ ID NO: 48946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaataaccggggcaaccttgtgatattccc

SEQ ID NO: 48947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaataatttccgttttcagcatcggccccc

SEQ ID NO: 48948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatacgttcttgcaagctctatccgttgc

SEQ ID NO: 48949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatatacaagatttggtacactttgctgg

SEQ ID NO: 48950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatatgcaagacgatagaacccatactac

SEQ ID NO: 48951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatatttggtgacctctgtccctcctact

SEQ ID NO: 48952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatccagagccgctcgtatatggccctgg

SEQ ID NO: 48953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatcccagagaaaacgctaatgccacttc

SEQ ID NO: 48954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatcgagcggaaccccggacgtcccatcg

SEQ ID NO: 48955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatcgcaccggaaggggaacgtttacttg

SEQ ID NO: 48956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatcgcttctagctttcgatgaatcgtgg

SEQ ID NO: 48957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatcgtccgacgcgcaggtcagatgggtt

SEQ ID NO: 48958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatctgtcgtcatcggcatcgtccccctc

SEQ ID NO: 48959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatcttgtggggcatggcggactggggtg

SEQ ID NO: 48960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgagacgcacagtttccgatgtcgcga

SEQ ID NO: 48961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgcgctcggtccgattttggtcatgtt

SEQ ID NO: 48962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgcggcgagttagcggggtcagtgaat

SEQ ID NO: 48963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgcgggaagaattgagggttcgggctc

SEQ ID NO: 48964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgcggggtgtggggctgttagcaggtg

SEQ ID NO: 48965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgctctctttccggaatgcaatctgta

SEQ ID NO: 48966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatggcgtggcggggagtaacgtgaaccc

SEQ ID NO: 48967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgggcgggcagttttgatttagtcacg

SEQ ID NO: 48968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgtagtagacgtgtttatcgcgccacc

SEQ ID NO: 48969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgtgggttgacagttgcgcggcgttta

SEQ ID NO: 48970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaatgtgtcaggcaaaccgcgggccagggt

SEQ ID NO: 48971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaattaattgttataggtcccaacggagta

SEQ ID NO: 48972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaattatttactccgcgtggagttacggca

SEQ ID NO: 48973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaattcagccggacgtcaccaccgagtcgc

SEQ ID NO: 48974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaattcgaaattgggcttgaatgggctgtg

SEQ ID NO: 48975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaattgaaggttcgggacttcgctgacttg

SEQ ID NO: 48976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaattttgctacatttatcggtgttaggta

SEQ ID NO: 48977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaaagggaggaccggtttcagcggccct

SEQ ID NO: 48978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaaccaccgtttactcccttcacgagcg

SEQ ID NO: 48979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaaccgcatattttgattgttcatcgta

SEQ ID NO: 48980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaacggcttcctgttaatcaagcgcggt

SEQ ID NO: 48981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaaggtcatcaatggcaatggaccaagg

SEQ ID NO: 48982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaatagaggcgcctgacctcgtcccttt

SEQ ID NO: 48983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaatctcgcaacaggacactgcgcttct

SEQ ID NO: 48984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacacagagggagcctatataccctcagtg

SEQ ID NO: 48985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacacaggggcggttttcaggcctctacgt

SEQ ID NO: 48986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacacccgagatgccggacgacgggtctgt

SEQ ID NO: 48987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaccgatacgcctattagctcaacgaca

SEQ ID NO: 48988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacacgcctcatcagcaatgcactcggtga

SEQ ID NO: 48989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacactcgagcccatccttgcacgccgccg

SEQ ID NO: 48990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacactgggtcagcaaagcgttgggcatcg

SEQ ID NO: 48991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacagagacgcgaatgtagtataacaacga

SEQ ID NO: 48992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacagccgtcgagcggtcattcgtatgtgt

SEQ ID NO: 48993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacagcctcctagataggaatcatatcgac

SEQ ID NO: 48994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaggagaaaattgctttggacgaggtcg

SEQ ID NO: 48995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaggcaagcctgcccttcatcacgattt

SEQ ID NO: 48996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaggccttttcgcggaattggcacgctg

SEQ ID NO: 48997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacaggtccgtgggcaatcacctccctgtt

SEQ ID NO: 48998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacagtccacataggctcggagttgctggc

SEQ ID NO: 48999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacagttagctgcggactccagcgtgtgcg

SEQ ID NO: 49000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacagttggctcaaattttacttagcctgg

SEQ ID NO: 49001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacatacagctcgtcatcgtcacgcccctc

SEQ ID NO: 49002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacatcattggacgggcgccaaagttcggg

SEQ ID NO: 49003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacatcccttttttcgctccgatgaccagt

SEQ ID NO: 49004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacatggttcagaatcacgagtggcgatcg

SEQ ID NO: 49005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacattacgaacaatgggccgggttacggg

SEQ ID NO: 49006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccaaactaccatgtgcctgtcgatgggt

SEQ ID NO: 49007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccacaccgtccacctggggttgggtttc

SEQ ID NO: 49008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccagactcctgtgcataacgtgtcattg

SEQ ID NO: 49009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccagctggcctgctcgaacagttatagg

SEQ ID NO: 49010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccagtgtttgccatggacaaatcggtac

SEQ ID NO: 49011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccatatcgcgttcccggctacagatggt

SEQ ID NO: 49012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacccatacattcgtgcgcgaacttgctat

SEQ ID NO: 49013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccccaggcccacggatccgccatccatc

SEQ ID NO: 49014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacccccttccgtcctcgtcggtgcgcttg

SEQ ID NO: 49015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgaactgatgtcaatttggtcagcgcg

SEQ ID NO: 49016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgaatcttcagaggcatggattggccg

SEQ ID NO: 49017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgaggtgatctgcagtgcgtggcgcat

SEQ ID NO: 49018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgctactctgcgacagggtaaatttgc

SEQ ID NO: 49019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgctggttttacgtgactgcttaggga

SEQ ID NO: 49020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccggaacgacttagcctcagcactcgtc

SEQ ID NO: 49021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgggaaggggtgggcgcttgctctgtc

SEQ ID NO: 49022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgggtagtcgtgagtgcgtgatcggga

SEQ ID NO: 49023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgtactcgtgagcggatagttactcta

SEQ ID NO: 49024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaccgtgactaaacatcatgggcgcacagg

SEQ ID NO: 49025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacctaggctagtccactgcagtcggcgga

SEQ ID NO: 49026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacctcaccccagtatggacatgggcgata

SEQ ID NO: 49027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacctgactccacttgaagctgcaagcgtg

SEQ ID NO: 49028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgaaagcttgagggggatacgaccggcc

SEQ ID NO: 49029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgacctacacggcctgcactggcgtccc

SEQ ID NO: 49030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgacttcacgcaagaatgctacgggatt

SEQ ID NO: 49031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgagcaaaggccgacgaggctgccggga

SEQ ID NO: 49032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgagtagcggcagaccgatgtccaccgg

SEQ ID NO: 49033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgatagaaaaagtgcggattgggcccgt

SEQ ID NO: 49034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgatattggttggttcaggactctttaa

SEQ ID NO: 49035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgatcctctagaataaaacgctcggttt

SEQ ID NO: 49036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgatggtcgggagcgtacaagtaagaga

SEQ ID NO: 49037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgattaacgggtcataatcgttatttct

SEQ ID NO: 49038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcacaccaggatatgaactgctaattg

SEQ ID NO: 49039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcatgttctttgtcttacggtatagtc

SEQ ID NO: 49040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcatttatcgggtgagcaccactatgc

SEQ ID NO: 49041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgccgttaacaacggataccgtctgtcc

SEQ ID NO: 49042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcgagtgaaagttgagctcttctggat

SEQ ID NO: 49043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcgcacagacacctccgtcactttgcc

SEQ ID NO: 49044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcggtccttatgtacgctaaggcgccc

SEQ ID NO: 49045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgcggtgtatctgggaagacaggcagtg

SEQ ID NO: 49046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgctagtaggtggttttatcatgggggt

SEQ ID NO: 49047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgctcgaccctgtaccactcttgggcca

SEQ ID NO: 49048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgctgatcggggacccccctcggcgata

SEQ ID NO: 49049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggaaacttcatgagttacctcgacgtg

SEQ ID NO: 49050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggaacaagtgatggcgtgtttggggcg

SEQ ID NO: 49051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggaagcggtggggccgatggcatgtgg

SEQ ID NO: 49052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggaattagtgttcatagggttgtcctg

SEQ ID NO: 49053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggaattggacttcagcaagagccgagg

SEQ ID NO: 49054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggaccctgagtgggctacggggaacgg

SEQ ID NO: 49055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggagatcgatagaggtcgctaaacggg

SEQ ID NO: 49056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggatagtaagcgcatgtggccgtaatg

SEQ ID NO: 49057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggatggtacactgccgatagctctaat

SEQ ID NO: 49058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggatgtctgcacggcactttgattcct

SEQ ID NO: 49059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggattgtatgaagtcggtccgcaacgg

SEQ ID NO: 49060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggcagtgggcgcatagtgctgtgtttt

SEQ ID NO: 49061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggcgcgtgtaatgctcccacgctggcg

SEQ ID NO: 49062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggcggacacagggaccggaagttatga

SEQ ID NO: 49063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggctatcactcgattgcttatgggacg

SEQ ID NO: 49064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggctatgtgtgctttgttccgtctgtt

SEQ ID NO: 49065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggctcccagcatgctttccgtagtcat

SEQ ID NO: 49066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgggcgaggttggcacaataggcgaggt

SEQ ID NO: 49067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgggcttcagtactgctgttcgttcagg

SEQ ID NO: 49068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgggtgtccagttccatacttttcggat

SEQ ID NO: 49069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacggtgaagaaggcaaatacggtggaaag

SEQ ID NO: 49070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtaagaaccgcataggttatgtttgaa

SEQ ID NO: 49071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtagggaggtttgcatctattcatgcc

SEQ ID NO: 49072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtaggtttatgacgaagagagatagta

SEQ ID NO: 49073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtatgagccggtgcgagtttctttact

SEQ ID NO: 49074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtcaaattaccaattaagcggttggcg

SEQ ID NO: 49075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtcctccctctacgggcaaagaaggca

SEQ ID NO: 49076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtcggtatggctgtgcgttgcgggtat

SEQ ID NO: 49077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtgagcaggcggtttacgtgagcacgc

SEQ ID NO: 49078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtgtcctgtttggactcggtaactccg

SEQ ID NO: 49079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtgttactccagcagccctcaaccttc

SEQ ID NO: 49080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgttatcaacacttattcagtgcgtata

SEQ ID NO: 49081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgttctgtctgccggtcggtcgttcggc

SEQ ID NO: 49082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgttcttacggcgggtcatgaggacgat

SEQ ID NO: 49083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgttgcgtttgggatttgccggtttcga

SEQ ID NO: 49084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgtttgatgagtccacgttattgtgtcg

SEQ ID NO: 49085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacgttttaagaggcaagactctgcacctt

SEQ ID NO: 49086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactaaagtagtgtgactttttactgccgg

SEQ ID NO: 49087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactaagattaaaggaagatgaggtggtca

SEQ ID NO: 49088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactaccacacagtcggaccctctccagtt

SEQ ID NO: 49089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactacccacctcaggcctgctttgagctc

SEQ ID NO: 49090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactacccgttggatgtccatgtgtggctc

SEQ ID NO: 49091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactagtagagacaagaagatgcacgcatc

SEQ ID NO: 49092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactataattaggtatggtaaatgcctaga

SEQ ID NO: 49093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactattcgtgcaggcttgggtgaaggcat

SEQ ID NO: 49094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactcagtgaacgcttctacctatgttgac

SEQ ID NO: 49095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactcatgaactgattgcttggctcctttg

SEQ ID NO: 49096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactcatttgtggtgcgcttttgttcaggc

SEQ ID NO: 49097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactcctcttagctactgaccgaccagatt

SEQ ID NO: 49098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactcggtagacggctctcattgagtaggg

SEQ ID NO: 49099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactgactatgtagcggaacggtcaccttg

SEQ ID NO: 49100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactgagagggggcagagattttaggagaa

SEQ ID NO: 49101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactggataggagaatttcatgcagatagt

SEQ ID NO: 49102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactggcacgtcggaaccgtcctttgaagc

SEQ ID NO: 49103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactgtaaacggctgccaggtacggtcatg

SEQ ID NO: 49104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcactgtcattaggccttaagtgtatttgcg

SEQ ID NO: 49105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacttatccttcaatcgtattagagaacaa

SEQ ID NO: 49106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacttcactttcttgtgaccttgggcaggg

SEQ ID NO: 49107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacttccatgccgggcaggcggttccgcgc

SEQ ID NO: 49108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacttcgtctgccacgtggtcttcaaaagc

SEQ ID NO: 49109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcacttgtgtagaaagcatacattgcagatc

SEQ ID NO: 49110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagaaggcagccctttgatttcgccaaagt

SEQ ID NO: 49111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagaatacgcggtgtgcagtggcgtcatgg

SEQ ID NO: 49112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagaatcttggtccggaagctggctctcct

SEQ ID NO: 49113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagacctcgctacggcactgtgtctgggcc

SEQ ID NO: 49114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagacctctgtcttcttgagtcacgttgga

SEQ ID NO: 49115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagaccttatccagggattgataccttccg

SEQ ID NO: 49116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagacggcgagggtttgatttgaacggcgc

SEQ ID NO: 49117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagactcctgggatgcgctactcggaccgg

SEQ ID NO: 49118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagactgtcgaactctcaacccaacgaatc

SEQ ID NO: 49119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagacttcaaaggtggaaacaacattctga

SEQ ID NO: 49120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagagaattaatcatatgtgctcgccttga

SEQ ID NO: 49121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagagattcacgcgttaggtttgttactga

SEQ ID NO: 49122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagagcacacttttcatcgtcgtttgcttt

SEQ ID NO: 49123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagagcctcgatagcggggtggtctcttgc

SEQ ID NO: 49124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagaggtcaaatcttccgctacagctccca

SEQ ID NO: 49125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagaggtctctcacatcctactcattgcgg

SEQ ID NO: 49126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagagttatccaaccgacacggatgacggt

SEQ ID NO: 49127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagatattgcgcaagcatcagtactagcgg

SEQ ID NO: 49128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagatcactgttgctgcgtgttctcaggtt

SEQ ID NO: 49129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagatcagcaggacctataccgagtatgca

SEQ ID NO: 49130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagatgacgttgagtgggatttgtgcgccg

SEQ ID NO: 49131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagatgtggagtgaagcacagggaaagggg

SEQ ID NO: 49132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagattacaatgctcgaggtttcccttctt

SEQ ID NO: 49133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcaaacaccagtcatgcactacatgtga

SEQ ID NO: 49134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcaacggtcgcacggtgtctccgtgttg

SEQ ID NO: 49135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcaagacgactgtggatttggatcgcga

SEQ ID NO: 49136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcacaacttcttgtgaatggttcaagag

SEQ ID NO: 49137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcacgcagtcagttaggaataactagca

SEQ ID NO: 49138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcacgctaacaatgtgacgttttgggtc

SEQ ID NO: 49139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcacgttagggcttgcaaccgccatgta

SEQ ID NO: 49140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcagatcaacttggtagtaccggctttg

SEQ ID NO: 49141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcagccagggattggtgcagcatttcgc

SEQ ID NO: 49142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcatgcgcactttgctggtcactcgtac

SEQ ID NO: 49143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccaccgcgatgcgtcgttccgcactta

SEQ ID NO: 49144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccatcactttgttttgtgccacgagag

SEQ ID NO: 49145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccatcctactatgttctttgtcggtgg

SEQ ID NO: 49146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccctcataagcgggcttggtggcacga

SEQ ID NO: 49147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccctttcgtacatgtgctggctagctg

SEQ ID NO: 49148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccgacgcgccgctattcccgcaagccg

SEQ ID NO: 49149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccgcctaacccgggcctcgcgtatggg

SEQ ID NO: 49150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccggcttagaaaggtggctcctggttg

SEQ ID NO: 49151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcctcacccatcaacgactcacggcggt

SEQ ID NO: 49152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcctgtggaaggcaaacgtcggtgacgc

SEQ ID NO: 49153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccttagatgggttccggttttctcggc

SEQ ID NO: 49154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagccttgcgatgaagaagttgttgacatc

SEQ ID NO: 49155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgatgggaaagtggagcggagtgggcg

SEQ ID NO: 49156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgcggatctctttgtgtaagttcatcc

SEQ ID NO: 49157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgcggtgactagcgaactgtgggttgg

SEQ ID NO: 49158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgcgtgacacatgaacgcgtattatgg

SEQ ID NO: 49159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcggaatatggggagtgtaatggtgctg

SEQ ID NO: 49160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcggacaatcgacatgttccggaaggcc

SEQ ID NO: 49161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcggaccagcctgtacatgcgccaggtg

SEQ ID NO: 49162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgggttacttcttattcacggaccttc

SEQ ID NO: 49163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgtactcaggttgccgaggcctcggtt

SEQ ID NO: 49164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgtctccaatgctgataggcggtgatt

SEQ ID NO: 49165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgtgcaacgcatttggactatccgggt

SEQ ID NO: 49166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcgttagactcatgcactaccgcgtcgg

SEQ ID NO: 49167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctaatcagcccaaccacctcgcaacgg

SEQ ID NO: 49168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctattgcggatccagctcggtgttgga

SEQ ID NO: 49169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctcggagaaattgctatgcgctggcaa

SEQ ID NO: 49170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctcgggcgctttaattcctggtagtac

SEQ ID NO: 49171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctcgttcgggcgttagtctcgcatgtc

SEQ ID NO: 49172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctgagcctcaaaattgccgtttttgtt

SEQ ID NO: 49173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctgcagcctgaaaccaaatggctctct

SEQ ID NO: 49174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctgcctagaggcctcagtacaggtttc

SEQ ID NO: 49175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagctggtcaaaacagtcagcctagtactg

SEQ ID NO: 49176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcttcattgtagcgttgtttacggtgcg

SEQ ID NO: 49177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagcttgccgtttcgtatcattccggtatt

SEQ ID NO: 49178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggaactatttccgcgaattacccccaat

SEQ ID NO: 49179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggacacgaagcttttaggcagtgtgtac

SEQ ID NO: 49180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggacagaaccaaggcgcgattagaggtt

SEQ ID NO: 49181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggacccaccgccaacacgcagattaacc

SEQ ID NO: 49182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggagaacaagcaggaaaatggcaacggc

SEQ ID NO: 49183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggagccctgtgattttgtgctattcgtg

SEQ ID NO: 49184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggaggagcagggcacgagaggtggatgc

SEQ ID NO: 49185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggaggagttaccagcctcaagcgctgac

SEQ ID NO: 49186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggagtatttgctaccgccagttcattgg

SEQ ID NO: 49187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggataaagggactcgctacgaaaattgg

SEQ ID NO: 49188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggataccgcatcatgcagtatggttttg

SEQ ID NO: 49189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggatacgacacttatgcttcggcacttc

SEQ ID NO: 49190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggatactccttcgtaaagtgtataggag

SEQ ID NO: 49191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggatcaagcacccccgctcgttgccacg

SEQ ID NO: 49192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggattcggtctatcctcggcgtttcata

SEQ ID NO: 49193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggcaaaacagtcacccacgtctttatac

SEQ ID NO: 49194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggcaaacagggatactgggatggcgcgg

SEQ ID NO: 49195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggcaaaggggagttgggacctgatgccc

SEQ ID NO: 49196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggcccggcgtgtccatgtctgttggagt

SEQ ID NO: 49197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggccttacgaacgaacgactccccggtc

SEQ ID NO: 49198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggcgggcacagtagggtgactgcggtgg

SEQ ID NO: 49199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggcgtgcggtgctaattggaatctctgt

SEQ ID NO: 49200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggacaagtatttagaggattgccacgc

SEQ ID NO: 49201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggaggacgccggtatggcgtaaaggcg

SEQ ID NO: 49202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggatccctcgtggtagggaggtacgcg

SEQ ID NO: 49203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggatcggagttacgcgcctcaattcga

SEQ ID NO: 49204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggatgttcgactcagaacgcaggagac

SEQ ID NO: 49205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggcgttgaccagccgttcgtacttagg

SEQ ID NO: 49206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggctcctgtggagcggagtggttcatc

SEQ ID NO: 49207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggggaaaacggactagatcaggaatggc

SEQ ID NO: 49208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggggtcctatacagaggcgtgagaatg

SEQ ID NO: 49209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggggtgtcgctaggggccctcatgtag

SEQ ID NO: 49210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagggtacactttcgggtatgactttagtc

SEQ ID NO: 49211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtacatggataccgcaaattactgtcg

SEQ ID NO: 49212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtaggtttgcgggttctaccaatctac

SEQ ID NO: 49213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtatcctccattcatgtgtaccgatgt

SEQ ID NO: 49214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtcaatataattgagccttagagcgct

SEQ ID NO: 49215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtccagagttagagacgggctggagtc

SEQ ID NO: 49216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtctccttcatggttcttctgttgtat

SEQ ID NO: 49217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtcttgagctactgtctgtgcatccgc

SEQ ID NO: 49218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtgcgcgcttctgtgactgtgggacgt

SEQ ID NO: 49219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtgctttacggtgtcgggatttgggaa

SEQ ID NO: 49220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtggcataccagaccaggttttctgtg

SEQ ID NO: 49221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggttggcgtcgatcgggtaatagcgtgg

SEQ ID NO: 49222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggttgtcgatgcttctaggtccactcaa

SEQ ID NO: 49223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggttgtctcgcacatgcagatcggtagg

SEQ ID NO: 49224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtttcatttgggatgagttcagctttt

SEQ ID NO: 49225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcaggtttccccgggactatccgtaattgtg

SEQ ID NO: 49226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtaaccggtacacgcttttggtggagac

SEQ ID NO: 49227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtagctgcggtgcgcggcgcatatgcgg

SEQ ID NO: 49228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtagggccgaattcccttcgcgcggtca

SEQ ID NO: 49229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtagtttttgggggtgtggcgtttgagc

SEQ ID NO: 49230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtcaagcgcgacaaatcattcacatgtc

SEQ ID NO: 49231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtcacggcgggcaacaagctgacggtca

SEQ ID NO: 49232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtcagctggttgaaacgagactcactcg

SEQ ID NO: 49233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtcaggggacgttgcccacagaaaggtt

SEQ ID NO: 49234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtccagatgagaactctggccatgcttt

SEQ ID NO: 49235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtcgcgaaaggggacatcgcaaaggggg

SEQ ID NO: 49236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtcggggccttacctgcttacgtctcgg

SEQ ID NO: 49237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtctacaaccctaattttcaatgtgcat

SEQ ID NO: 49238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgacttacaacctctttacttgcctaa

SEQ ID NO: 49239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgagatacctcacggcttcacttaatg

SEQ ID NO: 49240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgagggaacgtcagatcattgatatcg

SEQ ID NO: 49241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgatgctcccgcagagtttatattggc

SEQ ID NO: 49242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgatggtgcccaagagttgattggtct

SEQ ID NO: 49243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgcgaggaagtaacgggcgaaaagcgc

SEQ ID NO: 49244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtggagtggtatagttactcgcctgtat

SEQ ID NO: 49245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtggctcatgcgagttttagttcatatc

SEQ ID NO: 49246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgtgcgcatgttgctttcactgtgtga

SEQ ID NO: 49247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtgtttaagggtaaagctgggctttggc

SEQ ID NO: 49248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagttcgtcccacaagttcgtaccgccggc

SEQ ID NO: 49249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagttctgttcaagcctgtatgattatgtg

SEQ ID NO: 49250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagttgccgtaggttagcggatcgatgggt

SEQ ID NO: 49251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagttgctcggtggacacgcacagacgccg

SEQ ID NO: 49252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagttggacactcttacgggcggttgtgcg

SEQ ID NO: 49253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtttactagcttgttcagggggacgtga

SEQ ID NO: 49254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagtttgcacgcaggctgactagggcgttg

SEQ ID NO: 49255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcagttttatcgccttcaccgcgcaaggttt

SEQ ID NO: 49256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcataagtggttccgtgttgtgtcgactcat

SEQ ID NO: 49257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcataatctcggggtagcggtctgttccggt

SEQ ID NO: 49258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcataccgatcgtactagtagtgagtagctt

SEQ ID NO: 49259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatacggtgtctagcctaaactcatgttcg

SEQ ID NO: 49260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatacgtcagaccggcatagagtctcgtgg

SEQ ID NO: 49261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatactaggtcgtgtctttaagagttaggg

SEQ ID NO: 49262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatactgtacgtcccggtctgcaattgtgt

SEQ ID NO: 49263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatagagcgttagggtcggttgtaatgcta

SEQ ID NO: 49264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatagatagtatgtgacgcatgaggccgta

SEQ ID NO: 49265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatagcgcaaggtaggatgtcaggcggggc

SEQ ID NO: 49266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcataggctgccgagtacagtcccgcccggc

SEQ ID NO: 49267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatagggccagacagttcagacctctccac

SEQ ID NO: 49268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatagggccgactccagtcacccgcacgca

SEQ ID NO: 49269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatagggctagcgactggttgtctgagaga

SEQ ID NO: 49270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatcaacttcgtgtatttagcgagtgcc

SEQ ID NO: 49271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatcgacacctaatgcgcgattttggga

SEQ ID NO: 49272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatcgatatactcggggcggggaaggcg

SEQ ID NO: 49273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatcgttgtataataccacgctaaccgt

SEQ ID NO: 49274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatgcgagctctagcgtcactgtcatgg

SEQ ID NO: 49275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatgcggtaaacgatcaacaggaccggc

SEQ ID NO: 49276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatatgttttcctacagtcatcttacccga

SEQ ID NO: 49277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcaacagggcgtacatattcggatgtgg

SEQ ID NO: 49278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcaaccgattggaacacattgccttgac

SEQ ID NO: 49279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcacagctctatgcctacacgtcctttt

SEQ ID NO: 49280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcagaggtgggcttgtttgaaggatccg

SEQ ID NO: 49281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcagcgataatgcatttcctcggctctt

SEQ ID NO: 49282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcagtaagcccgctctttgtttactgtc

SEQ ID NO: 49283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcagtcgtggatcattcacaaatgactt

SEQ ID NO: 49284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcatacaattcggttagtccccttacat

SEQ ID NO: 49285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcattcggtcgccgagtcgtgattttgg

SEQ ID NO: 49286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatccaagccagtagtatgatgtctgtaga

SEQ ID NO: 49287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatccatgcgttatcgtgaagcaaggtgtc

SEQ ID NO: 49288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatccgagagttcctccgccctgcctggat

SEQ ID NO: 49289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatccggggactcaaagcgttgtggcgtaa

SEQ ID NO: 49290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcctgggcgaaccacaatgaggaagtct

SEQ ID NO: 49291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatccttgtcgtcctcccatttcgttgcct

SEQ ID NO: 49292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcggatgggacagtgcagcctagtcgag

SEQ ID NO: 49293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcggcagttggtccatcctacagacccc

SEQ ID NO: 49294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatcggtaatatcgcttgctcggagcggcg

SEQ ID NO: 49295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatctccccagacccggcggtagagtatga

SEQ ID NO: 49296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatctcggggagtcagtgcttctatcgcgg

SEQ ID NO: 49297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatctgcgatcggatttgagccgtgaattt

SEQ ID NO: 49298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatctgcgcggttatgcatttcctgctctc

SEQ ID NO: 49299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatctggaaactggcgacagtcacgtgtgc

SEQ ID NO: 49300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatctggacgttggttggacattactctgg

SEQ ID NO: 49301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgaaacacaacgagagtacacccacgtc

SEQ ID NO: 49302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgacccgatacagtcggggaactcgatc

SEQ ID NO: 49303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgacccgcagaaagttcattgcgacttc

SEQ ID NO: 49304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgacggagatgtggccggctcacggtgc

SEQ ID NO: 49305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgacggagtgcggtccgaatcgagtttg

SEQ ID NO: 49306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgagagcgctcgccctacgtaggaattc

SEQ ID NO: 49307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgagcactgatttcggcgcatgtcacgg

SEQ ID NO: 49308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgagggcgcatccagtttaacgggatac

SEQ ID NO: 49309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgagttcgattctacgcgggatagtagt

SEQ ID NO: 49310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgatgatcgcccgtcgttgcctccggga

SEQ ID NO: 49311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgatttctgtctgaagtgggcgttcact

SEQ ID NO: 49312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgcacgatggcaactccattcctgttgg

SEQ ID NO: 49313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgcagtattccgaggggttgcctctgcg

SEQ ID NO: 49314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgcatgaagggtatggccggtcacgccc

SEQ ID NO: 49315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgccgttcatttcgatgtacagcgtcac

SEQ ID NO: 49316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgcggagcagaagcacaatggcttgtga

SEQ ID NO: 49317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgcggtacgtttctgttcgagggcgtgc

SEQ ID NO: 49318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgcgtatcgtacgtttctgggggtgggg

SEQ ID NO: 49319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgctggtgtattttagattcgagtgctt

SEQ ID NO: 49320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggacatatggggggttcccctggtttg

SEQ ID NO: 49321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggacgatatgtgtcgcgtctcgccgtc

SEQ ID NO: 49322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggagcgaaggcggtattcaaagagttt

SEQ ID NO: 49323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggcatcggtagttgcatacaagtgtcc

SEQ ID NO: 49324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggcgagggaggctcgcaccgctttata

SEQ ID NO: 49325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgggatcggtttcatggttggttgcctt

SEQ ID NO: 49326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgggcagtccgttacgacttgggcggcg

SEQ ID NO: 49327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggtgcgtttaaacaagcgggcctatcg

SEQ ID NO: 49328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggtgtcagcatcttgctccagggacga

SEQ ID NO: 49329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatggttatgaagcggcacttcgcagcggg

SEQ ID NO: 49330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtaacgggggaagagctccacatcccg

SEQ ID NO: 49331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtagaggcataactcgctcatggggat

SEQ ID NO: 49332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtaggtgtggctgtgttaccgttggtg

SEQ ID NO: 49333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtagtctggggtagagagccggactgt

SEQ ID NO: 49334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtcggtaccggtacgcgcaaacccagg

SEQ ID NO: 49335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtcttcgcccgccttactttcctggcc

SEQ ID NO: 49336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtgcatcttctgtatactttgggatga

SEQ ID NO: 49337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtggtccagcgattagagtgtaacggc

SEQ ID NO: 49338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgttcagaggtccgtgcatcgtataggt

SEQ ID NO: 49339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgttcgctacatatacgtaaaccttgca

SEQ ID NO: 49340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatgtttggcaaggggaatggaattccgga

SEQ ID NO: 49341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattaaagcgccactgccacgtaaccgcct

SEQ ID NO: 49342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattacggcgtgagattattaggattgttc

SEQ ID NO: 49343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattacggcttgctagactctctctttcga

SEQ ID NO: 49344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattagatggttatgcaacagggaggcccc

SEQ ID NO: 49345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattaggttcactggtctgccgtaccgtgt

SEQ ID NO: 49346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattcaaagttagcggtggggcgaaatagg

SEQ ID NO: 49347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattccggttccgacgttagcttagcgtat

SEQ ID NO: 49348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattcgatcgaactcttcatcgttgttgag

SEQ ID NO: 49349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattcgcttcagggatcgaggtccttgaca

SEQ ID NO: 49350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattcggactccaggtgaacgccgacgtat

SEQ ID NO: 49351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattcgtggtcgcgtcaagcttgtttcatc

SEQ ID NO: 49352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattctcagacaatccggacaatcatacga

SEQ ID NO: 49353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgaaaggcgggcccacacgtcgacgta

SEQ ID NO: 49354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgcaacggtcggtcgttcttgggcgac

SEQ ID NO: 49355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgcagagaaatttcggttattacgcgc

SEQ ID NO: 49356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgctctcgatgtgcgtagggttcagtt

SEQ ID NO: 49357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgctgttgatacccatgagttaggccc

SEQ ID NO: 49358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgcttcggttttcctggatatagtcgc

SEQ ID NO: 49359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattggtacacctggtccgcacaatcccgg

SEQ ID NO: 49360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattggttttgaaacccccttcagagtcca

SEQ ID NO: 49361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgtaggactagtcagatgatattggcg

SEQ ID NO: 49362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcattgttagtgtatatccttttgccggtgg

SEQ ID NO: 49363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatttcacgtaacctgtggtaagcgtaatc

SEQ ID NO: 49364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatttcggtctcggtctcaccacagttttg

SEQ ID NO: 49365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatttgatccgtcgatgatatcatggtcgc

SEQ ID NO: 49366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatttgatgagcacgttcacaggccgtatt

SEQ ID NO: 49367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatttgggtgtagaagtccggtttgctggt

SEQ ID NO: 49368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcatttgtcccggcggtcggctttatacgaa

SEQ ID NO: 49369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaaaagattctgggcagcgggttttgtc

SEQ ID NO: 49370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaaaggacgtccagatcactacggcttt

SEQ ID NO: 49371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaacccttgttgataccgttggtactgt

SEQ ID NO: 49372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaactctggtggctcgtcgttcggagtg

SEQ ID NO: 49373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaaggatgcaggtgcttgggggtggggt

SEQ ID NO: 49374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaattgttcctctctctccacatgattc

SEQ ID NO: 49375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaacattagtcgatatccgagcggtttag

SEQ ID NO: 49376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaccacaattggagaccgagcgtagccc

SEQ ID NO: 49377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaacccgttaagtcttgcgattcgatcga

SEQ ID NO: 49378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaccgggatgaagttacgatcggagggg

SEQ ID NO: 49379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaacctgtacggtcagtttaaacggtcca

SEQ ID NO: 49380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaactgcaccgtgccgtcagattgcggcg

SEQ ID NO: 49381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaagcaacagactctttgcacttctaagc

SEQ ID NO: 49382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaagcctgggttttactctcggccgatcg

SEQ ID NO: 49383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaagcgcgatgaaattcgttaacgtgcga

SEQ ID NO: 49384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaggagcgtcggcatcctcatagcgtgt

SEQ ID NO: 49385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaaggatgcgttcttccgggcagagcact

SEQ ID NO: 49386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatagatagccgagtgctggctggtctg

SEQ ID NO: 49387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatccagcatatatcatcctagcaccct

SEQ ID NO: 49388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatccgaacaacatagggccacatacgc

SEQ ID NO: 49389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatcggtttcccctgacttcctattatt

SEQ ID NO: 49390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatgcctccgcgtggaacgatcgcttgc

SEQ ID NO: 49391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatgcgcacccttagatttcgtcgcacc

SEQ ID NO: 49392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaattcatttttcactggaactagagtat

SEQ ID NO: 49393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaatttgttaactgtttacctgatagctc

SEQ ID NO: 49394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacatcggcgttctctggtttatgcgagc

SEQ ID NO: 49395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacatgcagcacatgacgcctgcagcgtt

SEQ ID NO: 49396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccattgaccttttcgccgatgttgcaa

SEQ ID NO: 49397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccccctggagaacggacggtttgggtg

SEQ ID NO: 49398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccctaggacgcgtgacgccatgcgagc

SEQ ID NO: 49399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccgcggataggtttaactcagtctcgg

SEQ ID NO: 49400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccgggcaccatagctagactgcatcgg

SEQ ID NO: 49401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccgtgcacctgatacacgtagggtagc

SEQ ID NO: 49402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacctaatattggaaacagtacaagaggg

SEQ ID NO: 49403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacctattttacatggattttcccgctat

SEQ ID NO: 49404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaccttaagcggcagaaagtagcgcccac

SEQ ID NO: 49405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacgactcgataagttatcaaacggagtg

SEQ ID NO: 49406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacgatctcgagtacgatccctaacgccg

SEQ ID NO: 49407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacgccgtttatctttatccgtctgactt

SEQ ID NO: 49408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacgcgcataatcgacacaggaatacgcg

SEQ ID NO: 49409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacgggtatttggcggagcggggtacctt

SEQ ID NO: 49410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacgtttacgctggtgtggagtatctatg

SEQ ID NO: 49411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccactagttgtctttggttaagttgacctg

SEQ ID NO: 49412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccactgatagttatatgcactccctggaca

SEQ ID NO: 49413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacttgacgactgcagttccggctgccgc

SEQ ID NO: 49414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccacttgtatctctattacgggtctagccc

SEQ ID NO: 49415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagaatgggaccgccgccgacggttgatt

SEQ ID NO: 49416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagaccatcctggtagtgttaacgggggt

SEQ ID NO: 49417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagacgaacatgtgctgtactattacgcc

SEQ ID NO: 49418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagacgatcgcgggtgtgtcgaggtcagg

SEQ ID NO: 49419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagagcaaaggtcgcaatgggggtgtggg

SEQ ID NO: 49420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcaaaacctctgtgagagcaatgtcgg

SEQ ID NO: 49421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcaaacctccctgaatcgctcttttac

SEQ ID NO: 49422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcaattccttttacctctggcaacgtc

SEQ ID NO: 49423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagccagcgtgcttgtaggctatggttgg

SEQ ID NO: 49424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcccttgtgccgtgctgctaacacgca

SEQ ID NO: 49425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcgaccgtccaagtatacagagtagtt

SEQ ID NO: 49426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcgatattcggtctggatgggttgttg

SEQ ID NO: 49427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcgcatgggttttgtggaagcttggag

SEQ ID NO: 49428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcgcgttgcagattctcgggagctccg

SEQ ID NO: 49429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagcttggtcactaaacagaaacgccccc

SEQ ID NO: 49430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggacgcgcactccccgcaaagcatgtc

SEQ ID NO: 49431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggcgtgcttgcggtagtatacggatgc

SEQ ID NO: 49432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggctcccgagtcgtagccagcgtcaat

SEQ ID NO: 49433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggctgcgactttggcgcgtcccgaaca

SEQ ID NO: 49434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagggagcctgcatgggtctacgggaggc

SEQ ID NO: 49435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggggcctaccatgtactcgtgtatcac

SEQ ID NO: 49436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagggtgcgctgaactgggcggtggcggg

SEQ ID NO: 49437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggtaccgcatgacgtgatgcagtggtg

SEQ ID NO: 49438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggtcacacgccacaggagcacgaaatg

SEQ ID NO: 49439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccaggtcggttgaaactggatatcggcgtt

SEQ ID NO: 49440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagtaagatctgctcacaccggggctggg

SEQ ID NO: 49441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagtaatgtgcaaatgagcgaatttatga

SEQ ID NO: 49442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccagtccagttattctcgggctttatccgg

SEQ ID NO: 49443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatacattgatgttaaggcttaggacagt

SEQ ID NO: 49444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatagggcaaaacgacgcacctgccggag

SEQ ID NO: 49445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatagtgtccatttcacttggcaggccta

SEQ ID NO: 49446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatatcgaacaaacgctgctctcttaatt

SEQ ID NO: 49447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcaattcctattccatggggagcgtcg

SEQ ID NO: 49448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcagtagcgcgtcttcaggcgtagagc

SEQ ID NO: 49449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatccagtaggtaagtgcgctcgatgtgc

SEQ ID NO: 49450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcccgattgtcagtctcggtactttac

SEQ ID NO: 49451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatccgctctgactctgatgcgtttggcg

SEQ ID NO: 49452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcgacgacgtctcgtgtaatgccgttc

SEQ ID NO: 49453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcgccgcaggaggatcgctgtcgtact

SEQ ID NO: 49454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcgcctcttgccgcccctagactttcg

SEQ ID NO: 49455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcgtaccatcagccgacctgcatcccc

SEQ ID NO: 49456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatcgtgctgactaaggcgagtgtgcgta

SEQ ID NO: 49457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgagcatcttcgacgccgtgggttctt

SEQ ID NO: 49458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgaggtttccattattctttgtaaagg

SEQ ID NO: 49459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgattggtgggcgacgatgccgggagt

SEQ ID NO: 49460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgcgataacaaacgatctatacgcaga

SEQ ID NO: 49461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgcgcgtgcacgagctgtttgcggggg

SEQ ID NO: 49462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgcggtgggatagaggcacgagaaatt

SEQ ID NO: 49463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatggtagtcccttggtagccgtgcacgg

SEQ ID NO: 49464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatgtgtgccatctgaatcgtcatgggtg

SEQ ID NO: 49465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattaaacactttgacctcagcgttcttc

SEQ ID NO: 49466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattaagtaccgaggttgtggtcagcggg

SEQ ID NO: 49467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattattgtctagcggagctcagcggctg

SEQ ID NO: 49468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattccgcggctgcatgatgtcctgaggg

SEQ ID NO: 49469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattccgtcatgtgtctttgtactttgtt

SEQ ID NO: 49470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattcttttttgcacacatccgtacagta

SEQ ID NO: 49471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattgattttgtttccttgcaatgcacga

SEQ ID NO: 49472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccattgtgggctggtaccggcctcttcttc

SEQ ID NO: 49473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatttgatccgtcccttatatgctccgcg

SEQ ID NO: 49474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccatttgtctcgcgagatagacctgtccgg

SEQ ID NO: 49475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccaaaccccgagcatgcactatgcagaga

SEQ ID NO: 49476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccaaggtggtaagggaaagaggactcggc

SEQ ID NO: 49477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccaattcggcaggctttaggaagggacgt

SEQ ID NO: 49478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccaccctatgcgacacgtttaacgggttg

SEQ ID NO: 49479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccactcaccgcttaaatagggtggttcct

SEQ ID NO: 49480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccactcatttgttattctcaggacacttc

SEQ ID NO: 49481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccactgtagctcgtaggcgacgaccctcc

SEQ ID NO: 49482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccagttgccataggttgctcggacctgct

SEQ ID NO: 49483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccatcagagagcgaacggaactaagtgtg

SEQ ID NO: 49484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccatccaacaggctgtttgacagggggcg

SEQ ID NO: 49485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccattcctgcgcacattgagatctgaccc

SEQ ID NO: 49486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccccaggttctcaaagttgcaatttgctcg

SEQ ID NO: 49487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccccgcatggaaggctgggcgcaacgcgat

SEQ ID NO: 49488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccccgctctagctttaggttgccggtttga

SEQ ID NO: 49489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccccgttcactgcttaaaataccacactcg

SEQ ID NO: 49490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccccttgtcgaagacagggtgaatggtggc

SEQ ID NO: 49491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgaccagctacatgggcggcgctagggg

SEQ ID NO: 49492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgacgaaccatgatccacgctcgcggct

SEQ ID NO: 49493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgagatgcaccaatcgcgatctcgatct

SEQ ID NO: 49494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgagcgtccccccagctctgttaaccgt

SEQ ID NO: 49495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgcatcgagaaggtgaatctcgtcgcac

SEQ ID NO: 49496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgccatgttcgccggacagaaactcgag

SEQ ID NO: 49497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgcccccgcgagtccggcttggcacccc

SEQ ID NO: 49498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgccttacgtatgtctctgcttgttttc

SEQ ID NO: 49499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgcggggatttggcgttgcccgaagggg

SEQ ID NO: 49500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgcttcaaacaggttacgggaggggcac

SEQ ID NO: 49501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccggatatcgcgcgttgtaagtgtgtgtg

SEQ ID NO: 49502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccggcacgccggctttcgtgtgtcaatta

SEQ ID NO: 49503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccggcacgtaagcaggggagcccgatcta

SEQ ID NO: 49504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgggacgaaatcaaacagacggtagccc

SEQ ID NO: 49505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccggtgcatgcgttcaggggtgcgggcat

SEQ ID NO: 49506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgtatacccttcctacttgcaccatgcg

SEQ ID NO: 49507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgtatatctacctgtgccctccttgtcc

SEQ ID NO: 49508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgtgtgggggtgcgttgcgggggcttac

SEQ ID NO: 49509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccgttccatccggaagtggacgatttgtg

SEQ ID NO: 49510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctaatggatctcctgtccgcgccctcgc

SEQ ID NO: 49511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctagaggcatttacgttttgtttggtga

SEQ ID NO: 49512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctccagaaacggggatccagtccaggag

SEQ ID NO: 49513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctcgagcgttttggtattccccgcgtcg

SEQ ID NO: 49514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctcggtaaaaacggtttgcctgcagacc

SEQ ID NO: 49515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctgtaattgatattgtggcgagttccac

SEQ ID NO: 49516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccctgtcaacagagtcagcatggctagtcg

SEQ ID NO: 49517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccttattgtaaatgtcaccacggctcttt

SEQ ID NO: 49518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcccttgatcaaagggtggcagttgcgcttt

SEQ ID NO: 49519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaaacactgctgtgtgcgcgcaatctcg

SEQ ID NO: 49520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaagcatggatgctttgttaccgcgtag

SEQ ID NO: 49521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaagggacttctttatgcttcagtgcgg

SEQ ID NO: 49522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaaggttggtacagtccaatcagtgatg

SEQ ID NO: 49523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgacaagcacgtcgatcaaccatgcgact

SEQ ID NO: 49524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgacagctagagcagtagcaagatactcg

SEQ ID NO: 49525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgacggatagggtgggcggacttcagcac

SEQ ID NO: 49526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgacggtgcatgcaaatcaaaaatctttc

SEQ ID NO: 49527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgacgttcagtaagggtgtctcgtcttac

SEQ ID NO: 49528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgacgttgggagagaagcggatagtcatc

SEQ ID NO: 49529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgactactagcttggttgttaacggtcga

SEQ ID NO: 49530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgactcaccttccgattgcagtttggagt

SEQ ID NO: 49531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgactcgttgctagcatgtgggtctggat

SEQ ID NO: 49532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagaactgctgcccggacatcagccctg

SEQ ID NO: 49533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagcagcggactgagagatcgtcctgcg

SEQ ID NO: 49534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagcggagacccaacggcaagtaccgga

SEQ ID NO: 49535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagcggaggcgtctttaccaaggaccgg

SEQ ID NO: 49536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagcttagtcgataaacgcaacacgttc

SEQ ID NO: 49537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaggcgagtcccccatgttgtgggctgc

SEQ ID NO: 49538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaggggtgctgtaaactggctaccctgc

SEQ ID NO: 49539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgaggtaggactggttagattgggcggct

SEQ ID NO: 49540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagtggaaaacgctggcggaggcgggtt

SEQ ID NO: 49541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagtgttcgttcgaaatgcaagtcagcg

SEQ ID NO: 49542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgagtttacggtaagggaagtgggctgtt

SEQ ID NO: 49543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatactagtatcactctggtgccggtgc

SEQ ID NO: 49544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatagattgcgttcatcaatacaactac

SEQ ID NO: 49545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatattttttagttcgacaccgcgcatg

SEQ ID NO: 49546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatccgctcgttgcttctacccgacact

SEQ ID NO: 49547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatcggagccaacacgcatgagttcgtg

SEQ ID NO: 49548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatgcaggttgacatggcattagtattc

SEQ ID NO: 49549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgatggagcgaggtacgaattacgaataa

SEQ ID NO: 49550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcaaaccgtacattggaagcgagatcca

SEQ ID NO: 49551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcaagcgtgaataggccgggtagttgtg

SEQ ID NO: 49552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcaatgtagcaacggggcaaacagctgg

SEQ ID NO: 49553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcaccgttcccaatgcatccatcgactg

SEQ ID NO: 49554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcagagatacccatggatagcgaccggg

SEQ ID NO: 49555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcaggtttaaatgtttgtgctggtggaa

SEQ ID NO: 49556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcagttcctatccgcaactagtaagccc

SEQ ID NO: 49557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcatcatcgggagttcgttgtggagggg

SEQ ID NO: 49558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcatcgttcgcgtctccgtcgaggtatc

SEQ ID NO: 49559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgccaaactatgggtctttaacagactgg

SEQ ID NO: 49560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgccaacccgcatttaactcataccttcg

SEQ ID NO: 49561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgccaatctttcgtcttctcgtgtcttcg

SEQ ID NO: 49562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgccattatggaggcgctgtgttagacgc

SEQ ID NO: 49563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgaactagcggggtggccgatagtaat

SEQ ID NO: 49564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgacgtggggcattcactggattatcg

SEQ ID NO: 49565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgagggtgtaagtgcacggctggtggc

SEQ ID NO: 49566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgcaggtatcgacacgggtgaatagta

SEQ ID NO: 49567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgctaagcagtccgacctgttcgagta

SEQ ID NO: 49568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcggatatcgaatgggtcgctcctcatt

SEQ ID NO: 49569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcggatggttgccatggacggataaggc

SEQ ID NO: 49570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcggcagctagaagagagggcttgagag

SEQ ID NO: 49571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcggctatctgtgtggaccgtgtcgcca

SEQ ID NO: 49572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcggtactgtattgtttcctgcgtcgcg

SEQ ID NO: 49573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgtaagtgggtcgtcgtagtctgtcga

SEQ ID NO: 49574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgtacagtactacccggtctggcttgc

SEQ ID NO: 49575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgtaggtttcagtgttcgtgctccgta

SEQ ID NO: 49576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgttaagcacggctatcttcgcggttt

SEQ ID NO: 49577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgttgatctgcgagacagcttaggtgg

SEQ ID NO: 49578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgtttcaaaggataacgctgtcgcgct

SEQ ID NO: 49579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgttttcttgacggtcggcttcatgaa

SEQ ID NO: 49580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgcgttttgattgctgcgaaccttcaact

SEQ ID NO: 49581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgctcaacaaggattcggggtgtccgcga

SEQ ID NO: 49582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgctttgtccagtcttgactgtgggagtg

SEQ ID NO: 49583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggaaatgcctgctctatttgatcgtcta

SEQ ID NO: 49584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggaagacgtacgacgagggaaagattta

SEQ ID NO: 49585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggaccgcatactgcatgtgtgagcagag

SEQ ID NO: 49586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggacgcgaccataaaactccatgttgga

SEQ ID NO: 49587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggaggagggttagccttatttagcgacg

SEQ ID NO: 49588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggagtggcacaaaatgcccgtttcgcaa

SEQ ID NO: 49589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggatagtgtctcggcaaagatgcttagc

SEQ ID NO: 49590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggatgggtgtccgcgtagtgtacgctgg

SEQ ID NO: 49591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggattggccgtcgttcccatttttcacg

SEQ ID NO: 49592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcaatgacatcggtcacgagtgggtgt

SEQ ID NO: 49593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcaccacaggctacactagatgtgcaa

SEQ ID NO: 49594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcacttaagccgggcgaccacggagag

SEQ ID NO: 49595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcaggatgttcttgtggcctggattca

SEQ ID NO: 49596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcattttaagatggcagcggcacgggg

SEQ ID NO: 49597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcattttgagttagactctcggttcac

SEQ ID NO: 49598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggccactctaggtcactaactggcaagt

SEQ ID NO: 49599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggccctggtgaccttgacaccagtatag

SEQ ID NO: 49600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggccgaggaaatcgttagtactacggtg

SEQ ID NO: 49601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcgacctaaagttctctaacgagtaac

SEQ ID NO: 49602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcgcaaatcggtcttaggagtgtatgg

SEQ ID NO: 49603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcggaagtcgtgcttatatggaacctc

SEQ ID NO: 49604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcggacactatagaggacgtggattct

SEQ ID NO: 49605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcgggctcacgaggtgcgtgggatgtg

SEQ ID NO: 49606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcgtggtggactgcactagatctctag

SEQ ID NO: 49607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcgttgtatgcggcgagttcagggggg

SEQ ID NO: 49608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggctaactgctttcgcaggctacggtgc

SEQ ID NO: 49609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggctcgctccacactgccatgatactgg

SEQ ID NO: 49610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggctgtctattccgtgacgcttgcctgg

SEQ ID NO: 49611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggcttcatgtgtaggatgcgggagacca

SEQ ID NO: 49612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggcaggtggaggtgaagcgggtattcg

SEQ ID NO: 49613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggccagctgctactaccgcaaattgcc

SEQ ID NO: 49614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggccatccggcttggtgttggtaaggg

SEQ ID NO: 49615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggccggcatacgttttgttctccaatg

SEQ ID NO: 49616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggccgtacgcacgtgtacacaggtcgt

SEQ ID NO: 49617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggcgatctttatgtctagtgttgttgc

SEQ ID NO: 49618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggggacgtctagctcaccttcaaccact

SEQ ID NO: 49619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggggatacttaatcgcgaccgtagtgcc

SEQ ID NO: 49620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggggatgactcgttatggtggtggaat

SEQ ID NO: 49621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggggtgacttcaagaatgttatgacta

SEQ ID NO: 49622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggggtcctcagtcgagactgagcttgaa

SEQ ID NO: 49623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgggtgcagcaccagctctcttcgggatg

SEQ ID NO: 49624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggtagatgtacttcctcagatacacttg

SEQ ID NO: 49625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggtccgtatgttcttggtgtcatgggta

SEQ ID NO: 49626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggtctgaatcgaatgggctcaacggtac

SEQ ID NO: 49627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggtcttggggcgtgaagggagggtcgtc

SEQ ID NO: 49628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggttatacaatggcactgtgttctgttg

SEQ ID NO: 49629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggttcattccctaaagacatgcgctcgg

SEQ ID NO: 49630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccggtttcctggaagcgcgtatccagttaa

SEQ ID NO: 49631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtaactagtcaacaggcacatgggtgac

SEQ ID NO: 49632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtaagcgtgcgtcagtgtacatctttac

SEQ ID NO: 49633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtacactggaactccgagcatccatgct

SEQ ID NO: 49634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtacccttctcgctgttttcgcacacgg

SEQ ID NO: 49635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtacgcccgatgaacggcttgcggacgt

SEQ ID NO: 49636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtagagctggagaacttgggccaatggg

SEQ ID NO: 49637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtagcgagtccatcagctcacgttgtcc

SEQ ID NO: 49638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtagtcgatgacccactcgtcctaacca

SEQ ID NO: 49639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtagtcgtctcttatttaactctttgcc

SEQ ID NO: 49640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtagtgcgggttacgacagcgcttgacc

SEQ ID NO: 49641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtatcgcatctaacgatcaatgtaatga

SEQ ID NO: 49642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtatgtacaggccctgcgaagggtttgc

SEQ ID NO: 49643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtcacttattttttcatagtgttgggaa

SEQ ID NO: 49644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtcagggatgtggagtcggtacaactcg

SEQ ID NO: 49645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtcatttaacttgtgtcgtgaatggggt

SEQ ID NO: 49646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtcggacattagctaccgttttgtatgg

SEQ ID NO: 49647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtcgtgtctaagggtcttggcaacttcg

SEQ ID NO: 49648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtctactagctccgtgcggtgtcggggg

SEQ ID NO: 49649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtctcgtgggcggtacgacgtgcggaaa

SEQ ID NO: 49650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgaaggagccaggagaattgacccgct

SEQ ID NO: 49651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgagtttccacatgtggttgctcaggc

SEQ ID NO: 49652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgcagcgactgggtacgagcatgatag

SEQ ID NO: 49653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgccgagaggggaatatacgatcctgc

SEQ ID NO: 49654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgggaagggtagaggggtcgcgggtgt

SEQ ID NO: 49655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtggtccaacagaactaagctggtggtg

SEQ ID NO: 49656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtggttgttggtgacgttctgaccatac

SEQ ID NO: 49657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgtctggggggtcttcagttggattgg

SEQ ID NO: 49658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtgtttaggacatcaggtaaccaggcgc

SEQ ID NO: 49659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttacaatcgtatgacgcaaagctcagt

SEQ ID NO: 49660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttagcattcgtgtcctggcattgagca

SEQ ID NO: 49661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttatactaggagtaagtggtggagcaa

SEQ ID NO: 49662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttatgcgttcggagagcgtccggcggg

SEQ ID NO: 49663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttcagtggtcatggcatgtgggacctg

SEQ ID NO: 49664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttctgcctaacgaactgctgacttcta

SEQ ID NO: 49665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttgcttggaagggtttctactacctgc

SEQ ID NO: 49666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttgtcgggtctgtccagtgttcttccg

SEQ ID NO: 49667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttgtgtcccccagtagcgcgttgtgcg

SEQ ID NO: 49668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtttcggttgtttgcccaatgggggatc

SEQ ID NO: 49669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgtttgggtaaacgcgaaactggtcgctt

SEQ ID NO: 49670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccgttttcggacgatggagactcgacactc

SEQ ID NO: 49671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctaaactttcacctggacggtttccgggc

SEQ ID NO: 49672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctaaagctggctgggaatttgctggggcg

SEQ ID NO: 49673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctaagtgaggtcttgacgtcgtttcgttt

SEQ ID NO: 49674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctaatggccacgcctagctggggtttggt

SEQ ID NO: 49675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctacatcgttcgtgtctctgctaggtata

SEQ ID NO: 49676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctacccagtaccttgcatgcattgcggcg

SEQ ID NO: 49677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctacgagactccgatgtaccgttcagaat

SEQ ID NO: 49678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctacgcgtcaaagttaggtggacaaatcc

SEQ ID NO: 49679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctatatcaagtgtgatacccttcccagca

SEQ ID NO: 49680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctattacacacgcatgttgaatagcgaag

SEQ ID NO: 49681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcaatagcacaactgcgtgtggggggcg

SEQ ID NO: 49682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcaggattattctcgttcttttaatggc

SEQ ID NO: 49683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcagttacggacgtttggttaagcccta

SEQ ID NO: 49684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcatagtcttagctgttttatctctggg

SEQ ID NO: 49685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctccagctccttttgcggtgctcatctgg

SEQ ID NO: 49686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctccattccgtttagatacatttagctct

SEQ ID NO: 49687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctccctgcgaagcccggactttgatttct

SEQ ID NO: 49688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcccttcagcgcagacccgtaaatgcgt

SEQ ID NO: 49689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctccgttccttgcggttgcgtccctgttc

SEQ ID NO: 49690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcctactcgccacatacacctgtcgttt

SEQ ID NO: 49691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctccttgagcgtctatccgtctcaatcgg

SEQ ID NO: 49692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgacagcgtgcgggaggcatcggtgcg

SEQ ID NO: 49693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgacgtgccaggctattggtatggtta

SEQ ID NO: 49694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgagacacgccttgtttgtctcaggag

SEQ ID NO: 49695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgaggtgattgtcgtgtcgagttgatc

SEQ ID NO: 49696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgcgttctgttacacttccagactccg

SEQ ID NO: 49697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcggacagtcgcacctcactcaagtctg

SEQ ID NO: 49698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcggcactagatataaatacgggtcagc

SEQ ID NO: 49699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcggggatcgccaaggtcttggtcgggt

SEQ ID NO: 49700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcggggtcagcgtatctcgccagttcta

SEQ ID NO: 49701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgggttcctaactgctgttgggggctg

SEQ ID NO: 49702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgtgactgcttgccctagcgctatcgg

SEQ ID NO: 49703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcgttaggcttcagatgcacttgtcttg

SEQ ID NO: 49704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctctaaggcacgtaagtttgtgatctcgg

SEQ ID NO: 49705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctctatcacgcgcagttctctggccacga

SEQ ID NO: 49706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctctgcttcgaatactatccaagggctgc

SEQ ID NO: 49707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctctgtaaagatctaccgctacggaggcg

SEQ ID NO: 49708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctcttttgcggtgttgttttgtttttgtc

SEQ ID NO: 49709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgaaaccagctttgggaaactgttctgg

SEQ ID NO: 49710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgaacgaactcccctgtttgcacgcgcg

SEQ ID NO: 49711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgatgatgcactgaaggctcggtaccgc

SEQ ID NO: 49712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgcaagacgtttcatacagtcttcgttt

SEQ ID NO: 49713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgccactttgccgtttcgaagggggtta

SEQ ID NO: 49714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgccgaatccggagaatcagcgtatttg

SEQ ID NO: 49715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgcgcagtagatgagcgaagcttaggat

SEQ ID NO: 49716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggaagatggtgggtactccagggacag

SEQ ID NO: 49717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggaccttatcgttattccttcagctgt

SEQ ID NO: 49718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggacgtatgacggatagatacaggctt

SEQ ID NO: 49719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggacgtcggctgaattcgggattgcgc

SEQ ID NO: 49720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggatggtcctttgtaggttccgctcgg

SEQ ID NO: 49721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgggaggtgatggatcgacggatacgca

SEQ ID NO: 49722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgggatgaaagccacgggttcgcgagcc

SEQ ID NO: 49723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgggtaagctattcgtacttttgcccgc

SEQ ID NO: 49724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggtataaggactggtgttgagcggggg

SEQ ID NO: 49725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggtattgctcaccataccaccggttca

SEQ ID NO: 49726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctggtggggatagttgcgaaaggcaccgg

SEQ ID NO: 49727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgtactcgtgcgcaaggtggcgaactgt

SEQ ID NO: 49728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgtatcgtctcgtcacaggtgtagcgat

SEQ ID NO: 49729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgtatttgtacactgaacttgagttgtg

SEQ ID NO: 49730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgtcatataggattggtcatagagcgtt

SEQ ID NO: 49731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgtctttcctttaaagcgtgtatggctg

SEQ ID NO: 49732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctgtgtcatccgatggataccgatgctct

SEQ ID NO: 49733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttacacgttgcacagaccggtctcacat

SEQ ID NO: 49734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttacagtgtttgggtaggctgctcgtgg

SEQ ID NO: 49735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttagtagtgggggttattgaaaggtggg

SEQ ID NO: 49736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcaatacgtataggcggtcatggctga

SEQ ID NO: 49737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcagatttggtgtgggtacttcgccgc

SEQ ID NO: 49738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcaggggtccagcggcgatctagggct

SEQ ID NO: 49739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttccccctgtccgctcgcgagggtcaca

SEQ ID NO: 49740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcccctggactggaacttgattgttat

SEQ ID NO: 49741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttccgccaatgacggttagtgtactttg

SEQ ID NO: 49742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcgaattgcgtgtcacccctttccttt

SEQ ID NO: 49743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcgcgatccggcgattctcggtttagg

SEQ ID NO: 49744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcgtcaattctttctgtttggtgttgt

SEQ ID NO: 49745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttcttcgaatctctcgattatttcggcg

SEQ ID NO: 49746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttgatcgtcgcggttagatatggtcgcg

SEQ ID NO: 49747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttgatgcatcttgctccagctgatagcc

SEQ ID NO: 49748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttgcgccgagtagacgtcgggtctgggc

SEQ ID NO: 49749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttggtgatgcatgcggctcgatacgggt

SEQ ID NO: 49750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttgtcaaaaactctcgggttccatctgt

SEQ ID NO: 49751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttgtgcagtatcgtggtaggggttcacg

SEQ ID NO: 49752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttgtggacgtcacgccgaggtccgcctc

SEQ ID NO: 49753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctttaaaatgtccgggaaaggggaaggcg

SEQ ID NO: 49754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctttagaaacatggcgctttgtaattctg

SEQ ID NO: 49755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctttatgggggtcttgtcgtttggagcgt

SEQ ID NO: 49756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctttcgttcccgtccattgcaacaagtgg

SEQ ID NO: 49757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctttgacccggacaagttgattgggaatc

SEQ ID NO: 49758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttttatggggtgattgcggttatatccg

SEQ ID NO: 49759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggccttttggcacacccaatcgatctatgctg

SEQ ID NO: 49760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcctttttgtcagctgctcctaaggcgagcg

SEQ ID NO: 49761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaaaaagtgtcttccgaaccatgaagga

SEQ ID NO: 49762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaacatgcaaattgttagcggtttaggc

SEQ ID NO: 49763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaatgcattacccgctcacgaatgggtt

SEQ ID NO: 49764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaatttcatgcgcggcgggattactaaa

SEQ ID NO: 49765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaacacgtaggattgcaccgtgcttcgtc

SEQ ID NO: 49766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaacggggggaccgtaatcttgggtgatg

SEQ ID NO: 49767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaacggggggttctagtttttcgcgtgat

SEQ ID NO: 49768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaacgtatgccttagggtgcctccaccgt

SEQ ID NO: 49769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaacgtgatgggtacggtacagccggctg

SEQ ID NO: 49770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaagcaacacgcgtgtactacctgatcca

SEQ ID NO: 49771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaagcaatggattaataccgcccggtcga

SEQ ID NO: 49772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaagcgcggggacccatatctctgtgacc

SEQ ID NO: 49773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggcaagggtgatctttaagctctgat

SEQ ID NO: 49774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggcctgccaagttctctcttcggatc

SEQ ID NO: 49775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggcgaagctagccggtgtccccgctt

SEQ ID NO: 49776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggcggattggatatcatgaatcggcc

SEQ ID NO: 49777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggcggtccgggtctatacaatagccc

SEQ ID NO: 49778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggtaccgcccctgcctctggatgtat

SEQ ID NO: 49779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggtctgagaattactcacgttattgc

SEQ ID NO: 49780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaaggttcaggagttggcagggccgatat

SEQ ID NO: 49781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaatatggttcaggcaaaggtctgcgtgc

SEQ ID NO: 49782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaatcgaggctctgagtaacggttattga

SEQ ID NO: 49783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaattacatcgctgagtgagctcgatgct

SEQ ID NO: 49784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacaaggccaactcaagctcgccaggttt

SEQ ID NO: 49785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacacaactgcgcgcaacaaccagagtag

SEQ ID NO: 49786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacacagtctaggttatcggcgcagtagg

SEQ ID NO: 49787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacacggttagccgggatctattcttggg

SEQ ID NO: 49788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacagccgggtctgcgtgacggggacaca

SEQ ID NO: 49789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacaggcggcatggagagcgaggtgcgat

SEQ ID NO: 49790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacaggtaaacatgctcccagtaacaatg

SEQ ID NO: 49791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacatcacccgatctatgtttcgccacga

SEQ ID NO: 49792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacatcccggagaccgcatatcgttcggc

SEQ ID NO: 49793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacatcgggcagggggacctcccgtcggg

SEQ ID NO: 49794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacatgagatgtaattgctagggaaggtt

SEQ ID NO: 49795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacatgtcaaagatggcgaccggatgtgc

SEQ ID NO: 49796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaccagcaatggacagatccaaggctgag

SEQ ID NO: 49797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacctaaaaacggccgaagtagaccatcg

SEQ ID NO: 49798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacctgcgctggcgagcggttcttcgttg

SEQ ID NO: 49799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacgaatcgctgtccattctgtgtaccgc

SEQ ID NO: 49800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacgatccatgataaagacaccgcgaata

SEQ ID NO: 49801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacgcgtacggggacggttttgcggtcgt

SEQ ID NO: 49802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggactcacggcgactgtctatccgca

SEQ ID NO: 49803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggcgggtaacatactccggggcgcgt

SEQ ID NO: 49804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggcggttgcgtaacgtcactgacctc

SEQ ID NO: 49805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggggatgtagaggattgggtcgtggg

SEQ ID NO: 49806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggtcagctgcttcattcccggtcggg

SEQ ID NO: 49807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggtgtggcaactgaccgcgttagggg

SEQ ID NO: 49808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacggtttggcaagcaatctcccgggtat

SEQ ID NO: 49809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgactagcatacgaggtcagaagtgagtac

SEQ ID NO: 49810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgactccggccaaccgcgtgtacaaattgg

SEQ ID NO: 49811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgactctcgactgttttgaggttcgcttgc

SEQ ID NO: 49812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgactggttcgcagaacgggggttaatccg

SEQ ID NO: 49813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacttcgtacaatttggccttagtaggcg

SEQ ID NO: 49814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgacttggtctgcgcagtctaggtgttatg

SEQ ID NO: 49815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagaagtgattaaggcaattgacgcgggg

SEQ ID NO: 49816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagagaggcacggcggtatacagaccgac

SEQ ID NO: 49817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagagagtaggcgctcttgagtactctcg

SEQ ID NO: 49818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagagcgtcgtgcgcctgtttaattcggg

SEQ ID NO: 49819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagagggcaagcgcgcctcgtgattttcg

SEQ ID NO: 49820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagagtcatgtacactaaccgttttcccc

SEQ ID NO: 49821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagagtgcaatttggcaatcagaaggtgg

SEQ ID NO: 49822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcaacaccaacgaactgagtatgttgg

SEQ ID NO: 49823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcaacatggaatcacacgcgttagctg

SEQ ID NO: 49824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcaacccttagagtcctctggtcctta

SEQ ID NO: 49825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcaagtccagtgttggtagggaatgct

SEQ ID NO: 49826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcaatttcgacgcatgccgtccgctcc

SEQ ID NO: 49827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcactgttcactaatagaattccgcga

SEQ ID NO: 49828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcagaggacgcctcacgcggctttgcg

SEQ ID NO: 49829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcagaggctaggtacaatgcatgcgct

SEQ ID NO: 49830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagccgtcacgcgatttcggcatagatca

SEQ ID NO: 49831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcctaggtggagactacagtttggcgt

SEQ ID NO: 49832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcgatgttagagtaacttctataagta

SEQ ID NO: 49833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcgcgcaatgtgaaaatagccatgctt

SEQ ID NO: 49834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagcgctcatcaggggcgtaacgcgttgt

SEQ ID NO: 49835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagctagttcgggagttgttcgattctcg

SEQ ID NO: 49836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagctggccatctattcaccagtcccatt

SEQ ID NO: 49837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaggactatagacgttaacgcccgcctcg

SEQ ID NO: 49838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaggcatgcaggcggagggtgagtatgtt

SEQ ID NO: 49839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaggcggcattcgagggcttagtgatgtg

SEQ ID NO: 49840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaggcttttctgagtcggagcgttagcct

SEQ ID NO: 49841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagggaatagtccttctgttaaaacgtgt

SEQ ID NO: 49842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagggccggcagtcattaagcttccatgc

SEQ ID NO: 49843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaggggccgcatcatgttaggattcctcg

SEQ ID NO: 49844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagggtgtgtggctgcatcaacttgtgtg

SEQ ID NO: 49845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgaggtccatacccgaatcggcctaagtgg

SEQ ID NO: 49846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtacgtccgtgtggtcgcatgggatgc

SEQ ID NO: 49847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtatgcttcttcactacagggtgatgt

SEQ ID NO: 49848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtcaccgctatgctcttgaatttcggc

SEQ ID NO: 49849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtcgggattttagttatccttagaacg

SEQ ID NO: 49850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtgacaggaagacgtatgtcgtcggga

SEQ ID NO: 49851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtgggggctccatctgaccccgggccg

SEQ ID NO: 49852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtgggggtcttgagacatatctgcggc

SEQ ID NO: 49853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtgttcgagtttcgataggatgttttt

SEQ ID NO: 49854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtgttcgcacgtgactagcgagatact

SEQ ID NO: 49855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagttaggtttggatcttcaagtcaaggc

SEQ ID NO: 49856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgagtttggatgtgcaatgagggtcacctg

SEQ ID NO: 49857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgataaacgtccagtccaaacttagaagcc

SEQ ID NO: 49858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgataacctgctctcgcctgcgaacgtgcg

SEQ ID NO: 49859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgataccgtccgttaggctctcatgatatc

SEQ ID NO: 49860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatacgacacgcctgtgcccgactatggc

SEQ ID NO: 49861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatactgcgcttcgttcctggtcctcact

SEQ ID NO: 49862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatagatgaaccatttgtgtgttcggtcc

SEQ ID NO: 49863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatagtgctgcattattcggtcgaggggg

SEQ ID NO: 49864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatatcaagcaaccccgcagtggataagc

SEQ ID NO: 49865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatatcgagggcagttctccgttgggcgg

SEQ ID NO: 49866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatatcgccggtccagtctgtcttagttc

SEQ ID NO: 49867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatcacacttacacctaacctgttgtcga

SEQ ID NO: 49868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatcagtcgggttcaaaccgcttgcaagc

SEQ ID NO: 49869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatcataggcatgggtaaccaagtacgcg

SEQ ID NO: 49870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatcatagtgggtgagctcgtgttggagc

SEQ ID NO: 49871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatcggaccagcgtatgagtaatcttgcg

SEQ ID NO: 49872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatcggtctccgtatggcagagcgctggt

SEQ ID NO: 49873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatctgagcggttcgattaggcctccatg

SEQ ID NO: 49874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatgcagcccaacacctttgatacgcgtt

SEQ ID NO: 49875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatgcgaccatttgtttggcgcatttaac

SEQ ID NO: 49876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatgggggaatggtagagacgcaacacat

SEQ ID NO: 49877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatgtttggcttgcggagggcagttgcgg

SEQ ID NO: 49878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatgtttgtccgacgctatcccctcgggt

SEQ ID NO: 49879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgattactatgcgatattatcgaaagtcga

SEQ ID NO: 49880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgattcgcagcggagtttcggaaggctcgg

SEQ ID NO: 49881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgattcgtcggattgcgtcgctctggttgt

SEQ ID NO: 49882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgattcgtgatgctctgacataaggccgcg

SEQ ID NO: 49883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgattggacgactcagttgagctgtttgct

SEQ ID NO: 49884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgattgtgtatggtacgtcttagtaacctg

SEQ ID NO: 49885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatttacggttctcggtacgacgccatcc

SEQ ID NO: 49886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgatttcggtcatggttgggtgagattcat

SEQ ID NO: 49887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaaaaactccattaaagatttacggctg

SEQ ID NO: 49888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaaaaggtgggcagtttagtcatcaagc

SEQ ID NO: 49889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaaaatgaccccattgttgtcctgcagt

SEQ ID NO: 49890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaaagtatcatcataccgagggtagcgg

SEQ ID NO: 49891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaactctaaaccttgtcgaggtctgcgt

SEQ ID NO: 49892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaagatagattgttctacggccccaccg

SEQ ID NO: 49893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaagtaagacaacctgcctaaggacggt

SEQ ID NO: 49894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaagttttggagacgacttctttagatt

SEQ ID NO: 49895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaatacaatggggagtgaatgggtagaa

SEQ ID NO: 49896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaatgcgtaatacgacagtggaggtcgc

SEQ ID NO: 49897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaattgggtaattgatgggcttagtacg

SEQ ID NO: 49898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacatggtagtgacgtcgttcatccgcc

SEQ ID NO: 49899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaccatctacggctccacgggctgggta

SEQ ID NO: 49900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacgaagatgcagggtagatcggctcta

SEQ ID NO: 49901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacgagagtcggagttggctgtacaggt

SEQ ID NO: 49902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacgctcgctggtgagatgaacgcggtt

SEQ ID NO: 49903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacgggcagggttcgtgaacgctatgtg

SEQ ID NO: 49904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacgtcccggaccttaagcttgcagcaa

SEQ ID NO: 49905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcacgtggcggggttcacgtatgctcagg

SEQ ID NO: 49906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagagtcagacccgagatagggagggca

SEQ ID NO: 49907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagataacgtctactaacatgccgctct

SEQ ID NO: 49908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagcatactaaagaagtcgtagctcgtc

SEQ ID NO: 49909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagccatctgccggcggccttctgaccg

SEQ ID NO: 49910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaggatattcgaggcagggtgaccatct

SEQ ID NO: 49911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcaggggtccgggaaaggccccccatgtg

SEQ ID NO: 49912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagtcaggattgcacagatcgcgggcgg

SEQ ID NO: 49913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagtgcgttttttctcgggtgctctatt

SEQ ID NO: 49914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcagtggagacaagcgtcaacctaaggac

SEQ ID NO: 49915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcataaggctcaaaggctgaagctaatgc

SEQ ID NO: 49916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcatacatgacgcggtcacctcgggctag

SEQ ID NO: 49917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcatatgctttgattgcgtgctatcgggg

SEQ ID NO: 49918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcatcatgctgggttgaccttctgcgtgc

SEQ ID NO: 49919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcatccagacccagtacatgccttgctcg

SEQ ID NO: 49920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcatctggtcattagcggtagaggcttga

SEQ ID NO: 49921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcattcccgaaactgttgagcaggaggcg

SEQ ID NO: 49922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcatttcgacatctcacttgtgctgtgtt

SEQ ID NO: 49923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccaaccacgggacgagtacccaacgcat

SEQ ID NO: 49924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccacgacagtcctcggttcggcatagtg

SEQ ID NO: 49925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccacgcgggaagcttttttggtggtgtc

SEQ ID NO: 49926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccacgtattgaagcttggatcctcgtag

SEQ ID NO: 49927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccagcagctcatttaagttagggacagc

SEQ ID NO: 49928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccatccaacatacctaaccggctcagcg

SEQ ID NO: 49929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccatggcccactttacactgtggtagga

SEQ ID NO: 49930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccatgtactccatttgagtttaagcgtt

SEQ ID NO: 49931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcccagtcaaagagtctgctggcatcggg

SEQ ID NO: 49932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcccgcgtcggattgtggctcgtgatgtc

SEQ ID NO: 49933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcccgggattattagttctcagtggtggg

SEQ ID NO: 49934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccctcgttcacggcactgcgtacgaacg

SEQ ID NO: 49935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccctgactcgcagccaaaaatcgggatc

SEQ ID NO: 49936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgaaggcaggaatacatgtgattgacg

SEQ ID NO: 49937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgaatgacgacaaccagttcagtcgcg

SEQ ID NO: 49938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgacgatttcagcaccctgtccggcgt

SEQ ID NO: 49939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgatgtcagtggttcttgaggcgggtg

SEQ ID NO: 49940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgcaacactcgtcttttagtgcaactt

SEQ ID NO: 49941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgcgaaacgagacgaccggatgtcatc

SEQ ID NO: 49942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgcggtgtgaggctatacggtactgtg

SEQ ID NO: 49943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccggaagcgttgccctacaggtcggtcg

SEQ ID NO: 49944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccggagtattctccgcgggtacagcggg

SEQ ID NO: 49945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccggccggttgcgatagccaatgagcgc

SEQ ID NO: 49946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccggctggtacagtggagtgcttggccc

SEQ ID NO: 49947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgggacgcgtaggctccgtagggcatt

SEQ ID NO: 49948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccgttagcacacttttaagacgcttagc

SEQ ID NO: 49949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcctatgtttctcctctgtctttggcgtt

SEQ ID NO: 49950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcctcgtctcgggtccgggccttatctgc

SEQ ID NO: 49951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcctcgttactgttaatccgcgcgttgag

SEQ ID NO: 49952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcctgggctcacttgcaatgtgtagtgtg

SEQ ID NO: 49953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcctgtactgtcctgttgggtcttgcgtt

SEQ ID NO: 49954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgccttcccgttgacctgggacggttgtat

SEQ ID NO: 49955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgaaaacccagctcatgtacccacgatg

SEQ ID NO: 49956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgacagcatttgccctagcaacccggtg

SEQ ID NO: 49957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgacatggacacgggggttccgagatgc

SEQ ID NO: 49958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgacattaggcgaactgtgcgtctggtc

SEQ ID NO: 49959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgactgggcctacttgcaagcctgctcc

SEQ ID NO: 49960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgagctaacgcctacaatgctctgatgc

SEQ ID NO: 49961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgaggtgtggtacgcggattagtataag

SEQ ID NO: 49962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgaggttggggacttcgacagtcatagg

SEQ ID NO: 49963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgagtataggctccacggtcgttgggca

SEQ ID NO: 49964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgagtatgcccaccatggaagtatagtc

SEQ ID NO: 49965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgagttgggcgaagtcattgcaccgacg

SEQ ID NO: 49966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgatccgtttgcgggaaaagctcaggga

SEQ ID NO: 49967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgattggcagatagccttccttgtttcc

SEQ ID NO: 49968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcaagtgagatactcggggctgaagct

SEQ ID NO: 49969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcacactggctaaggttaatctgggcc

SEQ ID NO: 49970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcaccagcatgcagggcctctgttcgg

SEQ ID NO: 49971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcaccgggggatctatttggccgatgt

SEQ ID NO: 49972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcagtgtgtctcgttcgggctctgtat

SEQ ID NO: 49973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcataggtgccggattggatcagaagg

SEQ ID NO: 49974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcatcgatgatactacaatgcgaagaa

SEQ ID NO: 49975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgcatgcattcttcatcgactatcgcgg

SEQ ID NO: 49976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgccaaaagactgggggagttctgctgg

SEQ ID NO: 49977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgccgtgtgggtatcggggtacttgata

SEQ ID NO: 49978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgctgaagctacgggcttttttcgtgtg

SEQ ID NO: 49979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgctggcagtgtccatccacttacacat

SEQ ID NO: 49980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcggcggggcgttctgagcgttcttcgga

SEQ ID NO: 49981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcggcttgtgacgtacaggggccgacatt

SEQ ID NO: 49982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgggaagttgatgcaagagtgcaatccg

SEQ ID NO: 49983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgggccgagcgcaatgtcaggtgtgtag

SEQ ID NO: 49984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgggctgagccatcgctggggtgatctt

SEQ ID NO: 49985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgggggatggtcgcaatgctgcaaggag

SEQ ID NO: 49986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgggtaccctctggagatggaatgtggc

SEQ ID NO: 49987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcggtcggggtaagtgacagaagttagtg

SEQ ID NO: 49988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcggtctagtgccaatcacagggatcatc

SEQ ID NO: 49989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcggtgtccgtgtatgtcatggggctatc

SEQ ID NO: 49990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcggtgtctgagcatctggtgttacggag

SEQ ID NO: 49991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtacgccaccgggcacttttcactggg

SEQ ID NO: 49992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtactgcttgacctaattgaccttgcc

SEQ ID NO: 49993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtcggaaagtcagagcaggccttacgg

SEQ ID NO: 49994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtcggtgcttccgtcaatagcgagttt

SEQ ID NO: 49995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtgaggaagcggttttcatagttctaa

SEQ ID NO: 49996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtgagtgtgggagggctgatcggaccg

SEQ ID NO: 49997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtgcgcaggttttcgtctggcaggcgt

SEQ ID NO: 49998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtgcgtcagatcatgtggagccgctgc

SEQ ID NO: 49999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgtgggtttggccatacggatggatatc

SEQ ID NO: 50000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcgttatgcttatccctctgttgtcggcg

SEQ ID NO: 50001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctaattcttgctctaggtgtggcacttc

SEQ ID NO: 50002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctacacaaaccgtaactcttggccgtcc

SEQ ID NO: 50003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctacgtgtacctgtaattcaggccaggt

SEQ ID NO: 50004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctataatcgagctactcgggccattgcc

SEQ ID NO: 50005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctatgaagtcggccactggtttaggttc

SEQ ID NO: 50006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctattccagcacatacgcgatgctgacg

SEQ ID NO: 50007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcaacagctttattgagacccaccatg

SEQ ID NO: 50008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcacgtctatgcagccgtggatcgggc

SEQ ID NO: 50009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcatcagggtcaacccgggccctactg

SEQ ID NO: 50010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctccaatgcataacattaccgacttggt

SEQ ID NO: 50011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcccctctagcctgtgtagagggttgg

SEQ ID NO: 50012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcccctgcgcgatgttgcgttttacgg

SEQ ID NO: 50013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctccgaataacggatttctcaacttgtc

SEQ ID NO: 50014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctccggatcgcgattacacgggtcgctg

SEQ ID NO: 50015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcgaaaggacccattgggatcacggta

SEQ ID NO: 50016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcggggcccgacagttttagtgcgccg

SEQ ID NO: 50017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctcgggttgggtggcgaccttgtcccgc

SEQ ID NO: 50018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctgaggtagatggggggcctgttccgcg

SEQ ID NO: 50019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctgcatcagactggggagtcagcgttgc

SEQ ID NO: 50020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctgcatggcggtccaacgtttacgggac

SEQ ID NO: 50021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctgcgagcgtacgaggctgtcatgtggg

SEQ ID NO: 50022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctggtattacccaacggctggtaatgag

SEQ ID NO: 50023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctgtcaagataccgggcggtacgggcgg

SEQ ID NO: 50024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctgttacttaggcgtaaggcgccgttcc

SEQ ID NO: 50025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcttcactggtcgttgttctcggtttccg

SEQ ID NO: 50026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcttgacggtggcacattgcgtcatcgag

SEQ ID NO: 50027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgcttgcctggcaggtacatggtcggcaac

SEQ ID NO: 50028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgctttggtggacgtttgacatcatgttgc

SEQ ID NO: 50029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaaacgtccgttggattagtatcgtgtg

SEQ ID NO: 50030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaacacatggtttacgggcgaggttatc

SEQ ID NO: 50031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaacatggttgctagcttgggaattcgg

SEQ ID NO: 50032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaacggggagttattgcgaaacggggta

SEQ ID NO: 50033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaaggacataacccgctaaaccatctca

SEQ ID NO: 50034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaaggatatattctacgatcactgtgca

SEQ ID NO: 50035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaatcgtgcaaacaacgatcgatccgag

SEQ ID NO: 50036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaatgaaacgtgagtttatggggagaac

SEQ ID NO: 50037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaattcgttttctcgcgcaacccgggcg

SEQ ID NO: 50038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggacacaccctgtgctctggtcttgtttc

SEQ ID NO: 50039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggacattacacctatcagggatagttggg

SEQ ID NO: 50040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggacattgggcgcttctgggtttgagtag

SEQ ID NO: 50041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggacggatggcctaggattataccgcgtc

SEQ ID NO: 50042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggactaactcgcggactatcgcgatatgg

SEQ ID NO: 50043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggagagcgagcggtatgtgttagagttgt

SEQ ID NO: 50044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggagaggttttgcgtggcaggacgggagt

SEQ ID NO: 50045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggagcggcgtagcacaacttgctaggctg

SEQ ID NO: 50046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaggagggagttacttgttctttgtcac

SEQ ID NO: 50047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaggatatgtcaagtgcggatcacgggc

SEQ ID NO: 50048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggagggaagaatgccagcgatatcggggt

SEQ ID NO: 50049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggagggataacttgccaggttgggggacg

SEQ ID NO: 50050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggagggtcactctgtggctgcttgacatg

SEQ ID NO: 50051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaggtcatttcgactcagcgtattgggg

SEQ ID NO: 50052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggaggtccttagtctgtcggtgcgcctgg

SEQ ID NO: 50053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggataataagcgggcccgttgactgaata

SEQ ID NO: 50054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggattagcgtacggaccggccttctaacg

SEQ ID NO: 50055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggattccgaacgtgcggagcgtgggcggc

SEQ ID NO: 50056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggattttcgtaggcacaagcgaattgagt

SEQ ID NO: 50057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcaacattgctcgagcgcagacgcgtgt

SEQ ID NO: 50058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcaagtattactcactaattacgtggac

SEQ ID NO: 50059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcaatacacatgcacttcgtggtaagta

SEQ ID NO: 50060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcacactgaaatctagccccggaataca

SEQ ID NO: 50061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcacatagcgcgatagactcgtttattc

SEQ ID NO: 50062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcaccaattcgaatgataatcggcctgt

SEQ ID NO: 50063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcacgtaccttaagttggatattcgttt

SEQ ID NO: 50064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcactcacggggtaaaattcggcaatat

SEQ ID NO: 50065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcagtctactgggtctccgggtcattgg

SEQ ID NO: 50066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcagtgtggtttcacggtatcttatgtt

SEQ ID NO: 50067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcataccatcctcagtcggttagcatgt

SEQ ID NO: 50068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcatacgacttgcctatcacgtcatcgc

SEQ ID NO: 50069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcatagggccatgggccagtctttacgg

SEQ ID NO: 50070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcatgagaggaggggaaagacgtacgtg

SEQ ID NO: 50071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcatgggcgtaaccctcggcaactgaca

SEQ ID NO: 50072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggccagatttgatcgtcacacgggcctcg

SEQ ID NO: 50073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcccactaacgtcttgcacccgattacc

SEQ ID NO: 50074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcccaggtatttcggtacgtgacgggtg

SEQ ID NO: 50075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcccccgtccatccaagccacggggatg

SEQ ID NO: 50076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggccgacgattttaggttgggctgacacg

SEQ ID NO: 50077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggccggacctgatcttgcagctgtagttg

SEQ ID NO: 50078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggccggagaaagtcgcatcagattggcgg

SEQ ID NO: 50079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggccggtgtggctctagaggcggaacaag

SEQ ID NO: 50080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggccgtaagctctaaaacctggttttgat

SEQ ID NO: 50081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcctaaaggtgttcgtcgtggggagcgt

SEQ ID NO: 50082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcctgggctgctgtctctgccagtgcgg

SEQ ID NO: 50083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcgacagttcagcaaggtgcgggaggca

SEQ ID NO: 50084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcgatggtccatgcttactcgccctacg

SEQ ID NO: 50085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcgggtgcacgatcacctcggtattggg

SEQ ID NO: 50086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcgggttctgcactaaacgcttctcatt

SEQ ID NO: 50087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcgtaggaaaggagcaccttaggttttg

SEQ ID NO: 50088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcgtcgcggtcggttatgtgggtgtggg

SEQ ID NO: 50089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctaagtgtgcaggagagaagaccgcac

SEQ ID NO: 50090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctacattgtcggcaaggtaagctcggt

SEQ ID NO: 50091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctaccggaccacgaacgcccgccattc

SEQ ID NO: 50092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctagtaatatcaaactgaggacgtcgt

SEQ ID NO: 50093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctatgttacaagcagctgtgcgatctt

SEQ ID NO: 50094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctcgcagatcccaagtcggggtgggcg

SEQ ID NO: 50095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctctgcaagcttgctgtgcgtggtaac

SEQ ID NO: 50096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctgattgttgggctttacatgcttcgg

SEQ ID NO: 50097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctgcctcttaacgtgcaggttccgctt

SEQ ID NO: 50098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctggcggccaggtgtactgacatcggc

SEQ ID NO: 50099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctgtatgtccaacaggaaacctttccc

SEQ ID NO: 50100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcttagggtactcgtcatttccggcatt

SEQ ID NO: 50101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcttctaaccacgcgaccggtgtacgtt

SEQ ID NO: 50102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggctttgatcagggtgacgactgtcgtgg

SEQ ID NO: 50103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggcttttgtgctataccgggtgcaaaact

SEQ ID NO: 50104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggaaaggattcacggaacgctcctacgg

SEQ ID NO: 50105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggacacaatcgtttctactctggattcc

SEQ ID NO: 50106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggacacgtttggctacttctgattgcgg

SEQ ID NO: 50107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggacagcctggctcacatcttggatctc

SEQ ID NO: 50108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggacgttccactgtgacatacgtatacg

SEQ ID NO: 50109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggagatcgctatacgctattaaagctgg

SEQ ID NO: 50110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggaggcgcggaacgggttatggttcgcc

SEQ ID NO: 50111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggagtgtgcattgtgaccttctctgact

SEQ ID NO: 50112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggatctggattctgcacggtgccgtggt

SEQ ID NO: 50113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggattcgctcatgtcggctgcttgctgg

SEQ ID NO: 50114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggattgaacaatcagagttgtgcatccg

SEQ ID NO: 50115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggattggcactacatgtccccctacgtc

SEQ ID NO: 50116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcacggaaatggatgtggcgaggtggg

SEQ ID NO: 50117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcagcgccacctgcagttggcagcaga

SEQ ID NO: 50118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcatcagctacctctgtatcgcgtacc

SEQ ID NO: 50119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggccatataacaacgcgtacgtaccgct

SEQ ID NO: 50120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcccctctgcgcctggtcgagtctggc

SEQ ID NO: 50121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggccgactaaagctttcaacctacgcgg

SEQ ID NO: 50122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcctccgtttcgcttggcgaacgaata

SEQ ID NO: 50123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcgaaaaaacgcatgctaaggtccccg

SEQ ID NO: 50124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcgctctggttgatggggccgtcatac

SEQ ID NO: 50125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcgggagcattcgaatgtcaaccccga

SEQ ID NO: 50126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggcggtaaacgtagcccaatcacgtggc

SEQ ID NO: 50127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggctacagagcatccgcttcaacccccg

SEQ ID NO: 50128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggctgatcaaataggaggccctttttag

SEQ ID NO: 50129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggaacgtgtgataggttggttccctaa

SEQ ID NO: 50130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggaatgcgaaatcgacaggccatctac

SEQ ID NO: 50131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggacatgaggggctcgtcagcggtttg

SEQ ID NO: 50132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggagcccgaaatattttgtccgcttaa

SEQ ID NO: 50133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggaggtagggggctatccgcattcagg

SEQ ID NO: 50134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggatcgagggatggaattcctcagcct

SEQ ID NO: 50135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggcaatggccaggtggcgcctcgctcg

SEQ ID NO: 50136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggcgaaccagacaggcgttacgtgtag

SEQ ID NO: 50137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggcgttaaccccatgcgactgtacgcg

SEQ ID NO: 50138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggctgttgtgggagaggatgatgccta

SEQ ID NO: 50139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggggaaggactgcggactaaagggcgtc

SEQ ID NO: 50140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggggctcggtcgtaagcctcgggagcgc

SEQ ID NO: 50141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggggtcggggtagctcaaaggacgcgaa

SEQ ID NO: 50142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggtgcacttgagagtgcttgtccattt

SEQ ID NO: 50143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggtgtatggtctgactaccatactcgt

SEQ ID NO: 50144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggggttaatggtgcgttttggaagcggat

SEQ ID NO: 50145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtaggctactctttgttctaccacact

SEQ ID NO: 50146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtagtggcagctcgggggacaggtttg

SEQ ID NO: 50147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtagtgttgccgagtgacctttggaaa

SEQ ID NO: 50148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtcaaaatgtctgtacagggccggttc

SEQ ID NO: 50149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtcatgatgttaagcgtaacctaatgg

SEQ ID NO: 50150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtgcaggaataaggtggttcaactctc

SEQ ID NO: 50151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggtggtggacgtcgcttcacgctcatca

SEQ ID NO: 50152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggttagagcgtagggcttcggtcgtcca

SEQ ID NO: 50153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggttatcaccggctgggaccgtcctgcg

SEQ ID NO: 50154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgggttcaccttaacctgcattccgcatag

SEQ ID NO: 50155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtaagtgtaaggtccaccgcaccaggct

SEQ ID NO: 50156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtacaagagtgtggggacggcattgaag

SEQ ID NO: 50157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtacacatgattccctcatctatagaag

SEQ ID NO: 50158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtacgcgaactcgcggtccagtatcatt

SEQ ID NO: 50159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtacttgcacagggaacgcacgattctg

SEQ ID NO: 50160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtagaacaggcccttgcggcttagattc

SEQ ID NO: 50161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtagatcgtcgggccatacctctgagtg

SEQ ID NO: 50162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtagctgaagttgccgcatacgatggtc

SEQ ID NO: 50163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtagtccgttagcggggggaacctcgtg

SEQ ID NO: 50164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtatgccaatgtgtttccaacggcgcgg

SEQ ID NO: 50165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtatgcggattaatgggggtaaaggtcc

SEQ ID NO: 50166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcaactacaagtcaaccagcttggccg

SEQ ID NO: 50167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcaatcgtggcacagcggtgcgggacg

SEQ ID NO: 50168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcaatttttggcctttcagagtaagtc

SEQ ID NO: 50169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcagtgatgcatgatgattcggagggc

SEQ ID NO: 50170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcagtgggaaggcttcgtaaggcacgt

SEQ ID NO: 50171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcatacggacacttcaccttccttgct

SEQ ID NO: 50172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcatcatcggaaccccgactatgcggt

SEQ ID NO: 50173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtccaaggtgacgcttttcaagatcggt

SEQ ID NO: 50174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcccttatggtcttactgtgaaggcaa

SEQ ID NO: 50175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtctatctggtatgggaagtgtgcctgt

SEQ ID NO: 50176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtctgctggtactatactctcgatatgt

SEQ ID NO: 50177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtcttttggatcaatgtgtaggccaacc

SEQ ID NO: 50178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgacccagggcacggatgcgtattatg

SEQ ID NO: 50179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgagaccatgttggccagctgcggcac

SEQ ID NO: 50180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgaggctaacgcagattcgaatgcagc

SEQ ID NO: 50181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgatccaggtcgaacgcggccagcatt

SEQ ID NO: 50182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgatcgcgcggcgacatcatgagcgac

SEQ ID NO: 50183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgattgtatgcttgcgagcctcgcgga

SEQ ID NO: 50184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgattgttttccctggtgttgttgctt

SEQ ID NO: 50185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgcgatacccaggcctatgatggcgaa

SEQ ID NO: 50186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgcgtaagactctatattgtggcattt

SEQ ID NO: 50187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgctcggatctcatggtgggcattcct

SEQ ID NO: 50188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtggaccgtcatcgaattccgaagagcg

SEQ ID NO: 50189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtggaggttgatccactttgttaagcgt

SEQ ID NO: 50190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgtaatggttatcgacactgtaccggg

SEQ ID NO: 50191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgtacgtgtggtatggagcgcactgtc

SEQ ID NO: 50192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgtccgtcgatcgatcaggaaaatcgg

SEQ ID NO: 50193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtgtgctccacgtcgaatcgtaggctgt

SEQ ID NO: 50194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttaatggctggtctctacatggattgc

SEQ ID NO: 50195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttacattgcatcaggtttgctcgtcac

SEQ ID NO: 50196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttagtcttgcgtgttagtctaatcagc

SEQ ID NO: 50197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttatcactttggaaggcggcggttcaa

SEQ ID NO: 50198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttatgtgaacgggcgtgtcgtgctgcc

SEQ ID NO: 50199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttcaaggggattagttgagatcgggcc

SEQ ID NO: 50200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttcacagcatagtgcatttaactaggt

SEQ ID NO: 50201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttcgtacgcatcgtgtgtggccgaaag

SEQ ID NO: 50202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttcgttttcgtccttggagcttagctt

SEQ ID NO: 50203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttgagtggagagaatgcggcttcgggt

SEQ ID NO: 50204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttgcgagcgaggcttgaaagcggttac

SEQ ID NO: 50205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttgcgcacagcggtcttggatggcggg

SEQ ID NO: 50206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttgggctccgaactcatacagggcact

SEQ ID NO: 50207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttggtaatgcggatttcgtgcgttatg

SEQ ID NO: 50208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggttgtagtcctcagtggcctgtaagctt

SEQ ID NO: 50209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtttacccggtaggagttatcggaaccg

SEQ ID NO: 50210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtttacgctgctaaacaccatgggtcca

SEQ ID NO: 50211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtttcggtaagctttgaattagatgcgg

SEQ ID NO: 50212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcggtttgccacagggcgcgctcggttcggt

SEQ ID NO: 50213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtaaagacgatctgtggttttaacgggtg

SEQ ID NO: 50214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtaaagtccatcgagatccaggtccgatt

SEQ ID NO: 50215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtaaatcaataggcgctcgacttcggaga

SEQ ID NO: 50216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtaacagcaagaaggcgaacgggcgctgc

SEQ ID NO: 50217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtaagcagtgcatgtctgtatggcctgac

SEQ ID NO: 50218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtaatcaaactcttacaggggttgtatca

SEQ ID NO: 50219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacaactgctttctagccgcgctgggcg

SEQ ID NO: 50220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacaccgactgtgtattcgaacctcatt

SEQ ID NO: 50221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacactgccgagtgctgacctttagcgg

SEQ ID NO: 50222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacattgtcgggcgggtcatgcgctcgt

SEQ ID NO: 50223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacctcctcagttaacgagatcggagat

SEQ ID NO: 50224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacgataggccggcagatatggacgcat

SEQ ID NO: 50225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacgccgacctgcaattgatttccggtc

SEQ ID NO: 50226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacggacccttgctaataatcccgagtc

SEQ ID NO: 50227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtacgtatgtaacgggcgagagccattac

SEQ ID NO: 50228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtactatttgggaacgtcaaacgtctgct

SEQ ID NO: 50229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtactggcggaagcgatatggtcgacttg

SEQ ID NO: 50230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtactgtgtcactgctatggaatgaatgc

SEQ ID NO: 50231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagaggctcactctccagggggtcagtg

SEQ ID NO: 50232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagagttatgacccccttcctggcggta

SEQ ID NO: 50233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagcatgtctcactgagttccttcgagc

SEQ ID NO: 50234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagccggtagtggctggcttagtatcgg

SEQ ID NO: 50235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagctcggggattgatgggttaggacgc

SEQ ID NO: 50236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagggttcgaaaggacaggctccaatgg

SEQ ID NO: 50237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagtaccgacgatgcgaacttccatagc

SEQ ID NO: 50238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagtcatcccagtttaatgagtggaccg

SEQ ID NO: 50239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtagttgagtttagtgtgagaactggtat

SEQ ID NO: 50240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtataacttacgtacgcgtcagggtgtta

SEQ ID NO: 50241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtatccgcccgaccgctgtgacgagctac

SEQ ID NO: 50242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtatcgcgtacaccgccatggtggttgcc

SEQ ID NO: 50243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtatgacacacagagaaattgtcttcaaa

SEQ ID NO: 50244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtatggtagcaacagcaaagcccgatgtg

SEQ ID NO: 50245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtattgccgttgacgaaaggttactctgg

SEQ ID NO: 50246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtattgggtgactgtcactctggcggacg

SEQ ID NO: 50247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcaaggcggccgacacatcaccagcctg

SEQ ID NO: 50248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcacaggcagtagtttgtcagctcgggt

SEQ ID NO: 50249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcaggatcggcctttgcttggcaatgcg

SEQ ID NO: 50250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcagttttatgtccctgtcgattattgt

SEQ ID NO: 50251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcatgcgggtcgccgtgggttatccagc

SEQ ID NO: 50252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtccatcgtgagggtagctacggtacact

SEQ ID NO: 50253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcccacaaggcaacgtgtctctccaatg

SEQ ID NO: 50254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtccctcacatcactgaggcctggttggc

SEQ ID NO: 50255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtccctggggccttcggtattcctgcgta

SEQ ID NO: 50256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtccgacgagaatttttttttaccgacgg

SEQ ID NO: 50257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcctttgctgaacacagtttcgacgcga

SEQ ID NO: 50258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcgacagtatgtttacccttaccaacta

SEQ ID NO: 50259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcgacttgcaagtccggttagttggggc

SEQ ID NO: 50260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcgtggcctatgtccgtagtcagggcca

SEQ ID NO: 50261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcgttacttattctccgtcgttgggcct

SEQ ID NO: 50262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtctaataatttctgccatcaagcttcta

SEQ ID NO: 50263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtctacgtcaatacgttaccacgcgctgt

SEQ ID NO: 50264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtctcgagttctaaccagcatttttatgt

SEQ ID NO: 50265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtcttatgcggaatcggggagtgctgtgc

SEQ ID NO: 50266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgaacccgcgatgttcttggacgagcgc

SEQ ID NO: 50267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgaacctgtccgtttaccatcgaaaagt

SEQ ID NO: 50268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgacaaccgtacataatggggatcttag

SEQ ID NO: 50269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgaccaagtcttatcgacggcgcactcc

SEQ ID NO: 50270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgaggttgttgtcgatggggcagtctag

SEQ ID NO: 50271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgatacgcggctcggacttatattgcgc

SEQ ID NO: 50272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgatattggggataccctcttagcagtg

SEQ ID NO: 50273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgatgagacatggaggtgggggtactgc

SEQ ID NO: 50274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgatgttgctagctgttcctctctgtgc

SEQ ID NO: 50275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcaagaggttccgtattagagatcctg

SEQ ID NO: 50276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcaagttgccttcacgatctactgggg

SEQ ID NO: 50277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcaagtttggctgtacagcagcccgtc

SEQ ID NO: 50278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcagagctgggaggctggggaggggtc

SEQ ID NO: 50279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcatcacagctagcactctggaggttg

SEQ ID NO: 50280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcatcccatcactcgagggttcgctcg

SEQ ID NO: 50281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcatgcctggtctaaccgggacacgcg

SEQ ID NO: 50282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcattccgagaggaccttactcggcta

SEQ ID NO: 50283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcccaccccaaactcacacaacgatcc

SEQ ID NO: 50284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcccttacagattgtaacactgcattg

SEQ ID NO: 50285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgccggactcgctaaggacaccccgccg

SEQ ID NO: 50286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgccggagcctcgaatgggtagtcgccg

SEQ ID NO: 50287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgccggcctgattgctattcgtggaatc

SEQ ID NO: 50288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcgacccacggatcgtatcctaacacg

SEQ ID NO: 50289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcgggccagagagcaacgatgcgattc

SEQ ID NO: 50290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcggggggagtaaaccgatgccagctt

SEQ ID NO: 50291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcgtgaaggtcaagtccagcttcctgc

SEQ ID NO: 50292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgctactatttgtcactgaatttattcc

SEQ ID NO: 50293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgctatcatgggatcctagggttcgcct

SEQ ID NO: 50294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgcttttacgggtcagggggtcggatgg

SEQ ID NO: 50295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggcactttcaccgggatgatttagcta

SEQ ID NO: 50296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggcccaccttagtgcctgtccggtcgt

SEQ ID NO: 50297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgggagatcagagcaccggattggcatg

SEQ ID NO: 50298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgggctttgccgaatgcgactccttctc

SEQ ID NO: 50299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggggaggctgctcatgtgagatggcgt

SEQ ID NO: 50300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggggctcgtgtgatgtagaggttcgtt

SEQ ID NO: 50301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgggtgctggatttcgtgtagtatccgg

SEQ ID NO: 50302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggtaatggcacgatgctccgtcgcagg

SEQ ID NO: 50303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggtagctctcctgaggtttgggttgct

SEQ ID NO: 50304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtggtcggcaccgcgttacttacaccggg

SEQ ID NO: 50305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtacatgcttcgccggggttgatttgg

SEQ ID NO: 50306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtagcttgcttctccttcgaaataact

SEQ ID NO: 50307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtcaaagattgcagacaactgtgcgcc

SEQ ID NO: 50308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtcatgcagcgccataacgttgacgtc

SEQ ID NO: 50309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtccaggttgttatctgccacggtatc

SEQ ID NO: 50310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtcgcgtgttatcttttgcttggtgca

SEQ ID NO: 50311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtcggtccgtgagggaccgtgcgtcgt

SEQ ID NO: 50312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtgatggaggggcatatgtaggcggtc

SEQ ID NO: 50313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtggggtgagcggacatgttacgtgct

SEQ ID NO: 50314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtgtcataataatgctagcgtgggcct

SEQ ID NO: 50315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtgtcctaagctctagcgccagtcggt

SEQ ID NO: 50316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgttaattaatgtgcgacttactctctt

SEQ ID NO: 50317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgttaggtgggagcgggccattgacgcc

SEQ ID NO: 50318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgttattcattaaacattgactatgcca

SEQ ID NO: 50319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgttgctctcgcggagggtacgctgttc

SEQ ID NO: 50320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtgtttggcggagcgacgaagtacgcgtt

SEQ ID NO: 50321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttaacctctgaatgtgtacctttgggtc

SEQ ID NO: 50322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttacacagcacccgccgtacactagatg

SEQ ID NO: 50323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttagcgcaccagaacgtattgattcacc

SEQ ID NO: 50324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttatacggtcgttgttttcataccgatc

SEQ ID NO: 50325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttcaatgctgtcaccagtggtccatacg

SEQ ID NO: 50326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttcccttccttgttagcatacgggattc

SEQ ID NO: 50327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttcgctccgtactaagctgggggtttgc

SEQ ID NO: 50328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttcgttgtctggcacggtctgatgcgtg

SEQ ID NO: 50329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttgatgtgtggtaacccgaggcacagta

SEQ ID NO: 50330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttgcaatcttctcacagcggtgaaggaa

SEQ ID NO: 50331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttgccacctcacatgctaagcccacgtg

SEQ ID NO: 50332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttggaacagcggagttatggtctataca

SEQ ID NO: 50333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttgtacgcgtcgcagcttatcggcgcgg

SEQ ID NO: 50334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttgtcagactcgaactgacgtttggggt

SEQ ID NO: 50335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgttgtcggtccggcggccacattgactag

SEQ ID NO: 50336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtttacgtactcttatcggctaaggtcga

SEQ ID NO: 50337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtttcgcgtcagcttatggttgggtagac

SEQ ID NO: 50338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtttgatgtcatgtcatgtttatatctgc

SEQ ID NO: 50339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtttggacctgaagtgcggccgacggcac

SEQ ID NO: 50340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcgtttgtattcgcacgacgtaatctaggct

SEQ ID NO: 50341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaaaacacgtgatggatacatgtttgaa

SEQ ID NO: 50342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaaactgctctgctcaccagatgtgtgg

SEQ ID NO: 50343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaaaggtgactgcccttcaagcggccat

SEQ ID NO: 50344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaaccctatccgtgaagttgtggcgccg

SEQ ID NO: 50345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaagaacgcttcgtcattaatgattggc

SEQ ID NO: 50346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaattcaagtgccagttccttcttttgc

SEQ ID NO: 50347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaattccgtagcccaggcttggagcagc

SEQ ID NO: 50348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaacagggttcctcggtccaaccaaggtg

SEQ ID NO: 50349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaacatggatcgtcacgaataggttgctt

SEQ ID NO: 50350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaccacgatcggtcctctatgtccgtat

SEQ ID NO: 50351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaacgtatgtggactcggattgccgtgga

SEQ ID NO: 50352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaactaggcgatctcataccgccagatag

SEQ ID NO: 50353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaagagcagatgaccacgggcgcgaggca

SEQ ID NO: 50354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaagagtaacgttggcgcggacagtgtct

SEQ ID NO: 50355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaagcacctccacgtacttggtcttgtcc

SEQ ID NO: 50356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaaggtatccggcctgtcgtgtgcgtgct

SEQ ID NO: 50357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaagtagcacagttcattgtccggtaatc

SEQ ID NO: 50358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaagtggactcgcaattgttttttgtcta

SEQ ID NO: 50359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaatagttacagactttcctaggggatct

SEQ ID NO: 50360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaatcaagtgtccgacatatacctgactg

SEQ ID NO: 50361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaatcaggattcgtccgtgcgtaatttta

SEQ ID NO: 50362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaatgacgttgttgacgggatagatctcg

SEQ ID NO: 50363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaatgtcccaagggcttgccctaattgtg

SEQ ID NO: 50364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaattacctacgaggtgctacaagcccta

SEQ ID NO: 50365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacaacatgtaccgccggtaagcgttgcg

SEQ ID NO: 50366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacaatgcagcttcatcgctgcgttcgcg

SEQ ID NO: 50367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacactctgcgtggttacggtcaccggga

SEQ ID NO: 50368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacaggatcgtcccgggacaaactttggt

SEQ ID NO: 50369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacatgacgtcttggttggggggagctta

SEQ ID NO: 50370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacatggtccgtgccaccacactgggtgt

SEQ ID NO: 50371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaccatttagtactggactcagccgtagg

SEQ ID NO: 50372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacccgagaccttggttttggactgcagc

SEQ ID NO: 50373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacctattatgcttccggcaacacccgac

SEQ ID NO: 50374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacctcgagacgtcttcaattattccgtt

SEQ ID NO: 50375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacgaatggggttctaccacgaatctcgt

SEQ ID NO: 50376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacgatggtgtagtcgtgcagaatgttgt

SEQ ID NO: 50377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacggctacccaccttttggggaagagcc

SEQ ID NO: 50378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacgggcacgatacattagtattcgactg

SEQ ID NO: 50379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacgtgattgccttatcgcagtccgcctc

SEQ ID NO: 50380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctactgaactttgataacggtaattctctg

SEQ ID NO: 50381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctactggagttagaagagaattccccctgt

SEQ ID NO: 50382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctacttgctagggacggtctattggggtac

SEQ ID NO: 50383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagacaaacaatcgacagcccgagcgaca

SEQ ID NO: 50384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagagaatcgcacgaatcgctgcctcggc

SEQ ID NO: 50385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagagatcaggtcgtcttttctggggccc

SEQ ID NO: 50386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagatagcggcactcctcggactcttatt

SEQ ID NO: 50387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagcatttgtatgtcctgcgcaatgccta

SEQ ID NO: 50388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagcggcattacgaagcgcaccttgcaag

SEQ ID NO: 50389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagctgtagccgtctttcttcagcgcgcg

SEQ ID NO: 50390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaggactttagggtttagatccaagcgct

SEQ ID NO: 50391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaggaggcaacaccgcacttggttattcg

SEQ ID NO: 50392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctaggagtctgggtgcaggccctggaactc

SEQ ID NO: 50393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagggtttggtcgtttctggcttgtacac

SEQ ID NO: 50394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagtagcaaaaatcgagaataaatacggc

SEQ ID NO: 50395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagtcaatctgcatatttgtgtacagagc

SEQ ID NO: 50396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagtcaggttctgtccaccgtattacatt

SEQ ID NO: 50397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagttataaccggactcgcgggaggtggt

SEQ ID NO: 50398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctagtttgtgcagagccctgtcgcatcttc

SEQ ID NO: 50399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctataataatgtcgcagggaccagacaaaa

SEQ ID NO: 50400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatacagaggctacacttggtccatctcg

SEQ ID NO: 50401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctataccgcgtttgcatgaccttgagctcg

SEQ ID NO: 50402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctataccttgattcacgacccctcatcatc

SEQ ID NO: 50403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatatagtggattccctgttctagcggcg

SEQ ID NO: 50404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatatatcagactgaactgtgccttccgg

SEQ ID NO: 50405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatccatcgtgtggtttcgtcaggactgc

SEQ ID NO: 50406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatcccagggctcatgcgctctgagctgt

SEQ ID NO: 50407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatcctcttacggtctctctgtctggttt

SEQ ID NO: 50408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatctgtggctactggcagtttaactcta

SEQ ID NO: 50409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatgagcacgtccttggtcccgtcgcgct

SEQ ID NO: 50410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatgatcggttgtcgtttgtggcttttgt

SEQ ID NO: 50411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatgcattggggcgttcgacggggccttg

SEQ ID NO: 50412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatggtgacaatccagtttgtcccgctcg

SEQ ID NO: 50413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctatgtatcgcgaatggttcatcgactatc

SEQ ID NO: 50414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctattcaaatggtaaagtcttgtcccttgc

SEQ ID NO: 50415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctattcatcacagcgaccgaagggtggtct

SEQ ID NO: 50416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcaagcgcagcaccgcaaaggggagggct

SEQ ID NO: 50417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcaaggcgactccatcagctaagtcagtg

SEQ ID NO: 50418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcaatacggtaaaacattccggtggactc

SEQ ID NO: 50419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcacaacgactccatcccgactgccgccc

SEQ ID NO: 50420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcacatcgcaacatcgcaggcacgcccct

SEQ ID NO: 50421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcacccgacaaacccttgccggtctgtgt

SEQ ID NO: 50422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcacggaggttgggtgaatttgtggacat

SEQ ID NO: 50423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcacgtcaagagtcggcgcagcagggatc

SEQ ID NO: 50424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcacttcgcagcatcatcaccaacagggc

SEQ ID NO: 50425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagaaatacacgttagcgccctgctgga

SEQ ID NO: 50426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagatgtaaatacactagaaaggtcttc

SEQ ID NO: 50427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagcaatctacgaggatgtcgcccggca

SEQ ID NO: 50428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagcatgactattctaatagcgtttaat

SEQ ID NO: 50429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcaggccgggcgggtctctgtctgattcg

SEQ ID NO: 50430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagggacacgcttttacctaaactcatc

SEQ ID NO: 50431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcaggttagttacagccgtattttaaagg

SEQ ID NO: 50432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcaggttgatacaaacacgtccctctctc

SEQ ID NO: 50433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagtatggacacatcgcacagtgcggta

SEQ ID NO: 50434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagtgatgccttcaggtccctttcatcc

SEQ ID NO: 50435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcagtttggtttggttgcttaccgtagca

SEQ ID NO: 50436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcattactgtcgggtaagttaagctcgat

SEQ ID NO: 50437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccacaatgtatgcggactactcgtcgcg

SEQ ID NO: 50438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccacccgaggtgccttgcatacattctg

SEQ ID NO: 50439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccactccatcgggttccgcgttgtgagt

SEQ ID NO: 50440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccagcgaacgtcctgtgcaagatggctt

SEQ ID NO: 50441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccagggcggtcacgtgtctccatgccgt

SEQ ID NO: 50442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccattgatggcctggccggatactgctg

SEQ ID NO: 50443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcccaatgcgaccgggctgcgtatgttgc

SEQ ID NO: 50444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcccagcaagaaccttcatgggccatgcg

SEQ ID NO: 50445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcccatgcgtttcgtgatagttcatcgta

SEQ ID NO: 50446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcccctcacgatttattgtctctgttaca

SEQ ID NO: 50447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcccgttgatataagacaccgcaataata

SEQ ID NO: 50448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccgtaccaacacggactggcactgaagc

SEQ ID NO: 50449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcctctcacccacggttcagctactctct

SEQ ID NO: 50450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcctgatcatgatttcaaccacagtttcc

SEQ ID NO: 50451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccttagggtgcgacacaagagtccagtg

SEQ ID NO: 50452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctccttcaacaacatcatgacagcgttatg

SEQ ID NO: 50453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgacaggttgctgacgcggggaagggga

SEQ ID NO: 50454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgacgcgtgttctaatcctagtgcgttg

SEQ ID NO: 50455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgactaagcgtatttgtagtctggcgcg

SEQ ID NO: 50456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgatccgttagcgcgtggtggtgttcgg

SEQ ID NO: 50457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgatcggggggttttagctagcttatgc

SEQ ID NO: 50458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgcagtcgcagcgatctcggccttgtca

SEQ ID NO: 50459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgcgacgggcgtacgcagttcccacgga

SEQ ID NO: 50460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgcggatgtgcgggggttagggtcagag

SEQ ID NO: 50461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgcgtgaacatggtaggaatagcttagg

SEQ ID NO: 50462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgcgtgagatcgaagggcggcatccgat

SEQ ID NO: 50463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgcgtgtgcatctccctgccctacaccg

SEQ ID NO: 50464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggaaacattttacggttcaattcccgg

SEQ ID NO: 50465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggaactggcggctccccgttagcgaca

SEQ ID NO: 50466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggacacgcgttgtcctgcaaggcgtac

SEQ ID NO: 50467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggcggatagtgggctgtttacaggctc

SEQ ID NO: 50468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggcttatgtgagtggacggattaggcc

SEQ ID NO: 50469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggcttccgtatgcgtgtgcatgtttta

SEQ ID NO: 50470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgggagactaatggtgaattgttcagtt

SEQ ID NO: 50471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgggctttgtgattcttgggcctgctag

SEQ ID NO: 50472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggtgtacttgtgcgagtccaggaacgg

SEQ ID NO: 50473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggttggggtcgtagacgcatactctcg

SEQ ID NO: 50474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcggtttcaattagcgtaatcagctgaag

SEQ ID NO: 50475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgtaattcccacggatacgctatgcgtc

SEQ ID NO: 50476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgtcactctgtagggcgggacggtggtg

SEQ ID NO: 50477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgtcggacgggatctttgtaactcgctc

SEQ ID NO: 50478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgtgatagggagggcgtatggtagctgg

SEQ ID NO: 50479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcgttaccgctacccgcgatgctttttct

SEQ ID NO: 50480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctaagtatttgcacctcagtaacgcggg

SEQ ID NO: 50481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctaattcacaaccgcaacctcccgatgg

SEQ ID NO: 50482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctcaggtggtaaatcggctattcggcaa

SEQ ID NO: 50483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctcatgactattccagcaccgaacagat

SEQ ID NO: 50484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctccgcagtcttgttaacccgggaggtg

SEQ ID NO: 50485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctgcaggtggagataatgtcccacaccc

SEQ ID NO: 50486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctggggaccgttgttgtgtacagatagg

SEQ ID NO: 50487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctggtatggctgtgcaagttttccctgt

SEQ ID NO: 50488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctcttgttacgtaccaccgacaagggctcg

SEQ ID NO: 50489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctctttcaaggcactatggcgtgacggacg

SEQ ID NO: 50490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaacctgacgatgtcctatcaggggtcg

SEQ ID NO: 50491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaacgtccttgttataagccgcagacca

SEQ ID NO: 50492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaatggactgtgagttggttgcggctgc

SEQ ID NO: 50493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgacagtgtctgactcttcttgcctcgcc

SEQ ID NO: 50494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaccatgacggcaagttaaaatgatggt

SEQ ID NO: 50495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgacgataatatgctgcgatcaatggtta

SEQ ID NO: 50496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgacttgtggacattttaccaggtcgttt

SEQ ID NO: 50497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgagcaatcatctggtgccctgagggtgc

SEQ ID NO: 50498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgagccgatggtttggcctacacaccggc

SEQ ID NO: 50499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgagcgatgactccttggtaaagagcctc

SEQ ID NO: 50500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgagctacgggaggtgtgggcgtcccgcg

SEQ ID NO: 50501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaggggtctttaacgtaccgccacaagt

SEQ ID NO: 50502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaggggttatcagtcaatccctggaatg

SEQ ID NO: 50503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgaggtcccattcatttttctttccgggc

SEQ ID NO: 50504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgatatgggaggagggagaaggttgggag

SEQ ID NO: 50505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgatcagggtttatccacgttatttcgcc

SEQ ID NO: 50506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgattccgccagcccaagctcaggatggc

SEQ ID NO: 50507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcaaaggaatgctaagctcccgcttacc

SEQ ID NO: 50508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcaatgccagggggtaagcctcttgctc

SEQ ID NO: 50509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcaatgctgcataattcggcaccacttc

SEQ ID NO: 50510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcaatttaatcgtgattatcaacatacg

SEQ ID NO: 50511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcacaacaccgtcgtacaacctacggac

SEQ ID NO: 50512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcagaatacttgagggttgtaaggacac

SEQ ID NO: 50513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcagaccgtcctttggcccgcgctgtgt

SEQ ID NO: 50514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcagacttgaaggaccgagggtctgtag

SEQ ID NO: 50515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcatcaccaacaggatcgccttggactg

SEQ ID NO: 50516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcatcgctttgattgtacagctcgcgat

SEQ ID NO: 50517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcattaaatcacatgccgctggttggca

SEQ ID NO: 50518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcattggcgatcttaagctcaagcgggt

SEQ ID NO: 50519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgccaggatgctaatcggtgtgcgtatga

SEQ ID NO: 50520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcccgcttgtcaactccagtcctcgtta

SEQ ID NO: 50521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcccgtaatgcgtttaagtccgaagtat

SEQ ID NO: 50522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgccgttatgggggaggatcatgcacagt

SEQ ID NO: 50523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcctcctgggggttaccgtgttcggagg

SEQ ID NO: 50524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcctcgtccgtcttacatggctaccgtt

SEQ ID NO: 50525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcctggaaggggttttgtctgacgctcc

SEQ ID NO: 50526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgaattcagggggtagcgtcgggtcga

SEQ ID NO: 50527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgacaagtggttatttggattcggaat

SEQ ID NO: 50528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgacccgctggacaagatttacgggct

SEQ ID NO: 50529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgcactgtaggcttaccttcccctcgc

SEQ ID NO: 50530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgctgcgtggtgccaggctgcatgatt

SEQ ID NO: 50531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcggctcgaatctcgcgagtctcggtct

SEQ ID NO: 50532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcggggatcggactccttagatctgttc

SEQ ID NO: 50533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcggggggacgatgggatttggttgtgt

SEQ ID NO: 50534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgtacatgagcgatcgaggggcgctta

SEQ ID NO: 50535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgcgtgtacagcgttaggagagcaatctc

SEQ ID NO: 50536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgctaatcggcacggtctcaattgggcgt

SEQ ID NO: 50537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgctgagtcaatatgcctccactgacggg

SEQ ID NO: 50538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgctgctgcgaacgatgccatcttccgac

SEQ ID NO: 50539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgctgtacggaccgagacagagcttgaac

SEQ ID NO: 50540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggaacgggactacgacccctgcttcgcg

SEQ ID NO: 50541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggaagactccttcatgtgcgcgttggtc

SEQ ID NO: 50542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggacgatccctctcgcatctctaaggga

SEQ ID NO: 50543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggagggcccaccacctcgaatggaccgc

SEQ ID NO: 50544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcacagggaattgtacgatggctccaa

SEQ ID NO: 50545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcagctcaccggtatgcctttccacat

SEQ ID NO: 50546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcagtccgaagaaacatcaccaccgtg

SEQ ID NO: 50547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcctctaccccatgctattccagccgc

SEQ ID NO: 50548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcgcccaggctaatgtctcacgctggc

SEQ ID NO: 50549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcgggctgtctgtaggctcggggttgc

SEQ ID NO: 50550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcggtggcagagtttttacaagttcgg

SEQ ID NO: 50551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcttattgggtgagagagcgtccggtt

SEQ ID NO: 50552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggcttgacgagagaaccagttgcttggc

SEQ ID NO: 50553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgggaacaccgtcgcctggttctctggcg

SEQ ID NO: 50554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgggatctaagcattgatacatgatgaac

SEQ ID NO: 50555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggggagtctcagtggctccttggacgcc

SEQ ID NO: 50556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgggggatgggtgtttcagcagaactcgt

SEQ ID NO: 50557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggggtagctttcgtgtctgtaatccggg

SEQ ID NO: 50558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggggtgatgattccccacaccgacgcgg

SEQ ID NO: 50559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgggtcataccgatcctgtttgcttacga

SEQ ID NO: 50560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgggtggtagccggacttctcttcgctgc

SEQ ID NO: 50561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggtaaacgggttcagcgaggggcaggtg

SEQ ID NO: 50562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggtatgacggtgtagcctctcctccgcg

SEQ ID NO: 50563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggtcactagtcagggtgaggcgcgggcg

SEQ ID NO: 50564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggtcatgcaatgcttttaatctttctta

SEQ ID NO: 50565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggtcgaaccgtttgtaatcatcgttggc

SEQ ID NO: 50566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctggtggcgatagggttagattaccaactc

SEQ ID NO: 50567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtagatatggccaaacgatactggtgcg

SEQ ID NO: 50568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtaggctcggacggttcataggattcaa

SEQ ID NO: 50569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtaggggattatcatgtgtacactgcga

SEQ ID NO: 50570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtatgtcctcgtgggattttgagtaaat

SEQ ID NO: 50571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtcatactggtgctgtcttctcgtttca

SEQ ID NO: 50572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtcatagcctgactgtccggcttgactg

SEQ ID NO: 50573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtcccggttaatcggtaacgcaagcatc

SEQ ID NO: 50574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtcttgggtcgcttggtcggtgtaccga

SEQ ID NO: 50575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgagagctactctttgatgcacacaac

SEQ ID NO: 50576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgctcgcagccttgctacggctctctc

SEQ ID NO: 50577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgctctcgtcggatgcttaggtttaac

SEQ ID NO: 50578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtggcagcaagcagatcggcaaggatcc

SEQ ID NO: 50579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtggcctgtcaccgataccccgtcgccg

SEQ ID NO: 50580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtggcgctcgcaacattagctgcacatg

SEQ ID NO: 50581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgggcacgtgatagttgcggcatgcgc

SEQ ID NO: 50582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgggtctcacgagcggcttccagggtc

SEQ ID NO: 50583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtggtggctgggtttttggttttcggca

SEQ ID NO: 50584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtggttcgggtacggcggcgttcttcgc

SEQ ID NO: 50585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgtagttagggatgagctgggttttgt

SEQ ID NO: 50586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtgttcctctcgctgtctgtggaactag

SEQ ID NO: 50587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgttaggtaaacgcgggccagggcgtgtt

SEQ ID NO: 50588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgttagttgatgttggtacgtgtgaactg

SEQ ID NO: 50589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgttccattcccagtgctgtacgcgtaaa

SEQ ID NO: 50590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgttcctcacagggtacttcatatccctc

SEQ ID NO: 50591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctgtttgtgttttccgtgtcaccgccaatc

SEQ ID NO: 50592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttaatgttgcttcgcgggcttcgtgatca

SEQ ID NO: 50593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttacatgcgctgaagtaaagtggtgtgta

SEQ ID NO: 50594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttaccagccattcgctcagctatttcggt

SEQ ID NO: 50595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttacgaccggcggaatagtggatctgtat

SEQ ID NO: 50596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttacgagtatcgcactcggatgtctctca

SEQ ID NO: 50597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttacgcttacatgtacgcagtgcatgctt

SEQ ID NO: 50598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttactcgtgggctcaagtgcagggcgatc

SEQ ID NO: 50599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttagagtggctgatatctgtttgagtgga

SEQ ID NO: 50600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttagattggctaacgagcacccggttctt

SEQ ID NO: 50601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttagtgctattgccaggtgttcataccgc

SEQ ID NO: 50602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttagttagggttgcggcgacccaagtact

SEQ ID NO: 50603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttatgcgttagaacctcacgccttccgta

SEQ ID NO: 50604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttatttagatggatgctgagaggcacttg

SEQ ID NO: 50605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcaatggcgtctttccgatcttaatgcc

SEQ ID NO: 50606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcacctctagtctccgaaagccctctgg

SEQ ID NO: 50607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcacgcgagctcaaggggctttgcttac

SEQ ID NO: 50608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcacggaggtagtgagcgggtggtggtt

SEQ ID NO: 50609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcagagacaaccgagttaactggcacgc

SEQ ID NO: 50610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcagcgtgtacgcatcacccaatttcct

SEQ ID NO: 50611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcaggaaatgcctccagctgggcttgcc

SEQ ID NO: 50612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcaggcaggttcgtacatcacaaggcgg

SEQ ID NO: 50613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcatgtgatccgctagtgggctcaataa

SEQ ID NO: 50614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttccaatgtcctttgggaagtcggcattt

SEQ ID NO: 50615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttccgacagcacgattccttatggttagt

SEQ ID NO: 50616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcgaatagtgagtacctggggctgtggg

SEQ ID NO: 50617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcgcataaaggccaaccgtttgagcgtt

SEQ ID NO: 50618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcgcggggtgtggagtttttcgtctcgg

SEQ ID NO: 50619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcgctagagtgtctctcctcgttcttat

SEQ ID NO: 50620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcggcgattaggatgctatgcctcccgc

SEQ ID NO: 50621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcggcgtagctggcacaaccaactgccg

SEQ ID NO: 50622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcgggcggctttccgcctaacctcgttc

SEQ ID NO: 50623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcggtaaatccggtcccgtttcatcagc

SEQ ID NO: 50624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttctcggcgggccatatactttggtccgg

SEQ ID NO: 50625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttctgatcagtcggagtaggttgttgtgt

SEQ ID NO: 50626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttcttgatgacttttgtgttgcgtttgac

SEQ ID NO: 50627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttctttaacgtgttccaggagctacgcca

SEQ ID NO: 50628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttctttatttatcatttggacggccgggc

SEQ ID NO: 50629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgacgtcagaactgtaatcatgcctgcg

SEQ ID NO: 50630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgagaccggggtcggggggctgacattt

SEQ ID NO: 50631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgaggagaagcgatcacgttggcacaat

SEQ ID NO: 50632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgaggctgcacgttgttcgggttgccat

SEQ ID NO: 50633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgatcacgcggcactgttcatgaatggt

SEQ ID NO: 50634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgatcgttacttggcaaacccagttacg

SEQ ID NO: 50635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgatctaagctggattgccctcttcgta

SEQ ID NO: 50636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgattgctcttcgcatggtttacaggtt

SEQ ID NO: 50637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcaacctggcacccaacgacggcctcg

SEQ ID NO: 50638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcacggttcatcacagtgtggcccttt

SEQ ID NO: 50639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcaggaatagatgacatcaactaaagg

SEQ ID NO: 50640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcagtcttgcgcactgggctgtagcgc

SEQ ID NO: 50641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcatcatcatgccggatctataggccg

SEQ ID NO: 50642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcattcagcggactttatgtgccttcc

SEQ ID NO: 50643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcattttacgccgatatggcggtggga

SEQ ID NO: 50644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgcctgtagtgtcatcaagcgagtgggt

SEQ ID NO: 50645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttggaattaatgggaagagctaattgggg

SEQ ID NO: 50646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttggacgcgggtatgcgatcttgtgttag

SEQ ID NO: 50647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttggacgggttactcactggctgccgtgc

SEQ ID NO: 50648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgggagtgcttggcaaagtgtccaaccg

SEQ ID NO: 50649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgggtggcttgtctgagttcttgatcgc

SEQ ID NO: 50650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttggtagcatttttgatcacacttcgctg

SEQ ID NO: 50651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttggtcaccggcactaaatgtacctggcc

SEQ ID NO: 50652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttggtgcaggccgtatctactcccattac

SEQ ID NO: 50653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtaggtattcttcgggaacagcggcca

SEQ ID NO: 50654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtagtaatttcttgtagagtggattcg

SEQ ID NO: 50655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtatacgaagcgcttgcgtggtgtcgt

SEQ ID NO: 50656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtcctaccaaacatttcgatatctgtt

SEQ ID NO: 50657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtctggcgcggactgttatgtactccc

SEQ ID NO: 50658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgaaggcgcgagcacaccgagttcgt

SEQ ID NO: 50659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgacatcgggccgtctctggggaccg

SEQ ID NO: 50660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgattcaacggtgcgagtagaatgtg

SEQ ID NO: 50661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgcatttttaaagtgtccgaatgcgt

SEQ ID NO: 50662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgcggggtcctcgtttctatgtcccg

SEQ ID NO: 50663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtggctcagctgaaagctacagtgccg

SEQ ID NO: 50664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgtgttttcccattggtatgaagccg

SEQ ID NO: 50665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgtgtttcgtgcttccgggctagactga

SEQ ID NO: 50666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgttcagttgttaaccgcatgcaagcta

SEQ ID NO: 50667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgttccttcgaatgcgcgagaacggtgg

SEQ ID NO: 50668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgttcgttgaaggccgcatctgaattgt

SEQ ID NO: 50669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgttgaccgtgatggcggccagcggagt

SEQ ID NO: 50670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttgttgagatggggtgggtgcacaaatac

SEQ ID NO: 50671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttaacttgactggaatactgtgcgaata

SEQ ID NO: 50672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttaatttagtgcattagacctggccgtt

SEQ ID NO: 50673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttaggcatgcggggtccttatctcgggt

SEQ ID NO: 50674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttaggtttctcaatgatgcacgctctcg

SEQ ID NO: 50675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttcaactccgccatatcagtggttacat

SEQ ID NO: 50676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttcaatagaacatcccttcccaagcttt

SEQ ID NO: 50677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttccacctcagcgctcaggtgtcatggc

SEQ ID NO: 50678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttccatcctaatgctagggcactcccgc

SEQ ID NO: 50679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttcgataaacaaatcccccatcggaccg

SEQ ID NO: 50680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttcgcactagtcataggcgagtgtgtgg

SEQ ID NO: 50681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttcggcgctgcaaatagaaatctcgagt

SEQ ID NO: 50682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttcgggggggcgatcagatcaaaactcc

SEQ ID NO: 50683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttgagtctttcggcgtcgtcggtggttc

SEQ ID NO: 50684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttgcgatttttccttgcgagtgattcct

SEQ ID NO: 50685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttgcgtcggcttcgggcggtccgttatc

SEQ ID NO: 50686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttggcttgggtgttgctagcgagcggtc

SEQ ID NO: 50687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggctttgtaaacttcaatttaagcagttgagc

SEQ ID NO: 50688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttttacatcaattgtccactccatatgcg

SEQ ID NO: 50689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttttatacgaagtgagtgcttttgttctc

SEQ ID NO: 50690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttttctgggcttcggtatctcggctgtga

SEQ ID NO: 50691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttttgcgtgggcgagtaatgtgcgggccg

SEQ ID NO: 50692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggcttttgctgaggatggaatgcaccgaggtc

SEQ ID NO: 50693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaaattgctttcatcatcgcccgtcgtg

SEQ ID NO: 50694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaacccaggctaggttcgatgttggtgg

SEQ ID NO: 50695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaaccggagggtaggttgagatccctga

SEQ ID NO: 50696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaataagtatgtaattagtgtatggttt

SEQ ID NO: 50697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaatttgtgtcgttgcggtcggccgaga

SEQ ID NO: 50698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaacaaagactaaactaacgtatggagct

SEQ ID NO: 50699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaacatcgtccgcatgtcctccttggacc

SEQ ID NO: 50700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaacattgaagcggggggcgcgcaccttt

SEQ ID NO: 50701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaccaacgggaaagtggggcagtatcgt

SEQ ID NO: 50702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaacgggcgcctgattcattgtttgtcat

SEQ ID NO: 50703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaacgggtcttgcccaggcggaccttggg

SEQ ID NO: 50704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaacggtatgtggcccactacgcaggtgt

SEQ ID NO: 50705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaagactgccacgacgcatcggatgctat

SEQ ID NO: 50706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaagaggacaactaacctgtaatgaggct

SEQ ID NO: 50707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaggaagcgctaacggctttagcagtga

SEQ ID NO: 50708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaagggaagtataaggggatgtacgcgcg

SEQ ID NO: 50709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaaggttaatcggcaaagcccttcagcta

SEQ ID NO: 50710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaagtcgcaggctgcaaatgttaggcgtg

SEQ ID NO: 50711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaattccctaaacattaatggctgcatgg

SEQ ID NO: 50712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacaacggtggatgacatagatacgaccg

SEQ ID NO: 50713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacacgctgggcccgcggggtaggacagc

SEQ ID NO: 50714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacagatcggtgtttagcaaaggtttggc

SEQ ID NO: 50715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacagtgacccgggacatgtggtacactc

SEQ ID NO: 50716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacagtggtagcattcagggcgtgttgcg

SEQ ID NO: 50717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacataaaggcggacacaccgcgcagatt

SEQ ID NO: 50718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacatcagcggcgcacggcttcctcgggg

SEQ ID NO: 50719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaccgccacacttcaatgacgctcttagg

SEQ ID NO: 50720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaccgcgccggattggatcgcatgacttt

SEQ ID NO: 50721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaccggaatcgggatcttgtgaactttta

SEQ ID NO: 50722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaccggcctggtcatgtcattgtattctg

SEQ ID NO: 50723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaccgtacagtctcctagcgcaggccttg

SEQ ID NO: 50724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaccgtttctacgatttcaaattatatct

SEQ ID NO: 50725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacctgcctaaacgtgtttggaggttagt

SEQ ID NO: 50726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacctgttcaccctcgtcatagatggagc

SEQ ID NO: 50727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgacgggtcaggatgctctaccggccg

SEQ ID NO: 50728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgagccgaatacgtggagagaagtaag

SEQ ID NO: 50729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgcacaaacggacactacgctcaagaa

SEQ ID NO: 50730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgcgcttgatcgttacgtctgcttctc

SEQ ID NO: 50731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgctcataatgtgatgtgatatcgtgg

SEQ ID NO: 50732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacggaccatattgccggcacccctcgcg

SEQ ID NO: 50733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacggcatctaggacggcaggtcaaaagt

SEQ ID NO: 50734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgggcccggtgttgggtccacacaaac

SEQ ID NO: 50735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgggcctagaacctgcctttgtaagtc

SEQ ID NO: 50736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgggttgagggtatgcagctagctact

SEQ ID NO: 50737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgtcggacatcaggtatatggtttgcc

SEQ ID NO: 50738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaacgtgcgcaaggctttggacggtcccga

SEQ ID NO: 50739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaactcagtcagagtatggcccaggatggg

SEQ ID NO: 50740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaactgtacaacagttaacttgctacccct

SEQ ID NO: 50741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaactgtttcacacaaaggccagcactccg

SEQ ID NO: 50742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaactttgcgctaacctcccacctgatccc

SEQ ID NO: 50743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagagggtatttttggaaagctggtcctc

SEQ ID NO: 50744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagatagggacgcccaccatcacgccgcc

SEQ ID NO: 50745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagatcatggtgagaagcctgcccacagc

SEQ ID NO: 50746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagcaatacgaggtctcggcgaccgaatt

SEQ ID NO: 50747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagcagctgtctgttgaaggctctttgtt

SEQ ID NO: 50748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagcattagtctcgcttctctgaacttcc

SEQ ID NO: 50749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagccagtggtgaaaattgtagggccact

SEQ ID NO: 50750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagccggcctactaaccgatcccagggtc

SEQ ID NO: 50751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagccggcgtgggtctaggtggatgcttg

SEQ ID NO: 50752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagccgtagctctgtagtgcatctgggct

SEQ ID NO: 50753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagcctgttcgaacccgtgatggcggaag

SEQ ID NO: 50754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagcgacgggggagcgatcgagtggagtt

SEQ ID NO: 50755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagcgtgcaagggacgttgtccgctacgt

SEQ ID NO: 50756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagctgcataagagcgtccgtgggtggcg

SEQ ID NO: 50757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggaaaacggtgtcgtacggtcacatgc

SEQ ID NO: 50758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggagaacgcggccttacgatgggtctg

SEQ ID NO: 50759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggagcggttgagagccatgcgccgacc

SEQ ID NO: 50760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggcgagcgttaccctggggactggtaa

SEQ ID NO: 50761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggcgtggttccgcaaccggcaacgttt

SEQ ID NO: 50762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggggcggcggatgtgtcacttggcttg

SEQ ID NO: 50763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggtgtggtcaggcaaaagttcatgatg

SEQ ID NO: 50764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaaggttcaaggtctcacggtggagtgtcg

SEQ ID NO: 50765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtaagcgttgcgggagtgtttttggcg

SEQ ID NO: 50766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtataatactcttatgtgaaagcagag

SEQ ID NO: 50767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtccgtcgaggaggagcgacttgtttc

SEQ ID NO: 50768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtcttcgagaggctacgcaccgtgatc

SEQ ID NO: 50769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtgaatagcaagactggcgttcatgta

SEQ ID NO: 50770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtgccgatgatgtgcgcttgtaactcg

SEQ ID NO: 50771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaagtgccgtgcatttgtgacgggagggat

SEQ ID NO: 50772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatacacgtcctcatagttatggccaacc

SEQ ID NO: 50773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatacctcaagaaggtggcgcgaaatgtc

SEQ ID NO: 50774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatagacctaacagcttcggtcaggatat

SEQ ID NO: 50775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatagctcgggacttacttttgttccgtg

SEQ ID NO: 50776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatagtacagctctcatattccggtgcta

SEQ ID NO: 50777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatataaggctctatactgccggacttcg

SEQ ID NO: 50778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatcaccggcctaagattcttgctctatc

SEQ ID NO: 50779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatcagaccttatgcgggccgtcaatggg

SEQ ID NO: 50780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatcgccgtttcaagcactaggtgcgtgt

SEQ ID NO: 50781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatcggcatagcaacgacgtactcgagcc

SEQ ID NO: 50782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatgaccgccgatccgtctttcttcaagc

SEQ ID NO: 50783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaatggtttgatgagcacttgcatgggggg

SEQ ID NO: 50784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaattgtgtcggtagtgctgtctcggttcg

SEQ ID NO: 50785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaacgtcgccgttaagactctgcaccac

SEQ ID NO: 50786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaaggatcttgtttgattatggaaatcg

SEQ ID NO: 50787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaattaatgcactcgattctggctgtgt

SEQ ID NO: 50788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacacaatgcgtcggggcggccggttttct

SEQ ID NO: 50789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacacacctgccaaagatatcctgatccct

SEQ ID NO: 50790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacacacgggacgtactttaaacgctatgg

SEQ ID NO: 50791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacacatcaaacaggtacgtgtgcggtgtc

SEQ ID NO: 50792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaccaactgcaggcacggcacaatttcc

SEQ ID NO: 50793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaccctgtgactggcatccgactgggct

SEQ ID NO: 50794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacacggtacacgttcccacatggtgcgcg

SEQ ID NO: 50795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacacgtagggagcagggacgtgaacttcg

SEQ ID NO: 50796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacagagggtgctaggctggtcgtacttcg

SEQ ID NO: 50797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacagattggcagggccacaacggattctt

SEQ ID NO: 50798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacagcagctacacggcgaatctcgcaggc

SEQ ID NO: 50799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacagcattggcggtttggactagcgaacg

SEQ ID NO: 50800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaggccgtgtgtgggacaataaacgtgt

SEQ ID NO: 50801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaggtatggtgtcacaattccctttgct

SEQ ID NO: 50802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacaggtcctacggcacaccccaccggact

SEQ ID NO: 50803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacagtcagcgggggacccagaccagtcgg

SEQ ID NO: 50804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatatgccacacacccggaatgggcggg

SEQ ID NO: 50805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatcgccgtcgcatctttgtcctcgagt

SEQ ID NO: 50806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatcggcattaaggcagtggtgcaacca

SEQ ID NO: 50807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatgataggagctgtagtagccgttgtc

SEQ ID NO: 50808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatgatatccctggggattgtcgcagat

SEQ ID NO: 50809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatgatgattcatgtagcgcgggatgta

SEQ ID NO: 50810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacatggtgggtagcgccgacggctggggg

SEQ ID NO: 50811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacattgtatgcgtactgttatgccgggca

SEQ ID NO: 50812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacattttgtgatgtcgcgtgcccaatcgt

SEQ ID NO: 50813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccaacaaagacggacgcgatctccgctt

SEQ ID NO: 50814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccacagcgtagggggggccgcggttgct

SEQ ID NO: 50815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccaccacaagatcccctgtctcccgggg

SEQ ID NO: 50816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccagcagacgacattactgtgcgtacgc

SEQ ID NO: 50817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccagcgggcaacgtaggattaacgttcc

SEQ ID NO: 50818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccagtccacgctccgtccttaacggtct

SEQ ID NO: 50819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacccacagcttcgctcactcggccatcga

SEQ ID NO: 50820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacccagatggggttgtgttcatacatagc

SEQ ID NO: 50821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacccagtgacgacgatcaaaagctcggct

SEQ ID NO: 50822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccctgtctcgacctccatgctctccgcg

SEQ ID NO: 50823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgaaaacgggtataaaggcctatggct

SEQ ID NO: 50824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgaacgtggggtccattgatgcggccg

SEQ ID NO: 50825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgattaaagcccggggtctggcgtgtt

SEQ ID NO: 50826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgcaacgttaggaccgactttcaaccg

SEQ ID NO: 50827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgcataaccgaaacagctgtcaatgtc

SEQ ID NO: 50828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgcgaccggtatgcactgtgttgaacg

SEQ ID NO: 50829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgggcgaatatcttgttgccgctcgac

SEQ ID NO: 50830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccggggttggatctaggttcgctgcggc

SEQ ID NO: 50831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgtctggtagggccgacactcgggtta

SEQ ID NO: 50832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaccgtgcgggtaatgggtagaagaggtcc

SEQ ID NO: 50833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacctaccgatatacgatgccttgcctgga

SEQ ID NO: 50834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacctagggatcgtctgatgatcgcgagtc

SEQ ID NO: 50835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacctgatagtcgttgggaaggaagttggt

SEQ ID NO: 50836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacctgcactcctgcttttgacctctagca

SEQ ID NO: 50837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgaaatatccggaccgctaaatggcagt

SEQ ID NO: 50838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgaaggtatcatgggtgtctggccaagc

SEQ ID NO: 50839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgagcaccgatctgctccacggcaatag

SEQ ID NO: 50840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgagcgccgttgtgcatctttgggtttc

SEQ ID NO: 50841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgagctgcaagtatttatttagtaatcc

SEQ ID NO: 50842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgagttattgacgctgggacttgcgatg

SEQ ID NO: 50843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgatactgcctgtcgaatgtactcgatg

SEQ ID NO: 50844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgatagcccgagatggtgtcaccaagga

SEQ ID NO: 50845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgatggactaatgcgagcggggccttgc

SEQ ID NO: 50846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgatggtccgtattgtttcgtttggcca

SEQ ID NO: 50847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgattcatccaacacgggaagccgtagg

SEQ ID NO: 50848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcaacaggagtttgccgacgggggagg

SEQ ID NO: 50849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcaagacaattcgcgcatcggcgttcg

SEQ ID NO: 50850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcaatccggcgcaagttacgtcagctg

SEQ ID NO: 50851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcaccccgtatctttccatcgtgcggt

SEQ ID NO: 50852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcacgcttggattaagcacaccgcgaa

SEQ ID NO: 50853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcagtcggtcaaaactgtcgggttgcg

SEQ ID NO: 50854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgccaggctagtgcagttaaattcgggg

SEQ ID NO: 50855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcctggttccataccacgttccacccg

SEQ ID NO: 50856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgccttgtggagggggcacactccaagt

SEQ ID NO: 50857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgacgaacgcgatggtaaagaggcga

SEQ ID NO: 50858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgacgacagccctcataggcgtaagg

SEQ ID NO: 50859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgatctcgctggtgagctgtatgtca

SEQ ID NO: 50860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgcagacctcagtacagtacccggac

SEQ ID NO: 50861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgccgtgcgtagggtgaatgaggggc

SEQ ID NO: 50862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcggggggcagccccatctcccaatga

SEQ ID NO: 50863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgtgcgcttgagaaggtattaatcgt

SEQ ID NO: 50864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcgttggactggggatggtacagcccg

SEQ ID NO: 50865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgctcggtggagggcgcggccgtaagat

SEQ ID NO: 50866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgctctacattcatgggaaggtcctggc

SEQ ID NO: 50867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgcttggatgtcatacttttaaattctt

SEQ ID NO: 50868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgctttaggtgttatcgcagtagccggg

SEQ ID NO: 50869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggaccggaggcatactagagctggtgg

SEQ ID NO: 50870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggacctgtacgaggtaagtcacggacc

SEQ ID NO: 50871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggatcgcaacaagcaacttacacccgt

SEQ ID NO: 50872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggcacacgtaacggctccgcatattgg

SEQ ID NO: 50873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggccagggcttcgtcaggcgctccaaa

SEQ ID NO: 50874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggctgcataacagggggacagcgcgcg

SEQ ID NO: 50875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgggatctaggccacatcgataaagtgg

SEQ ID NO: 50876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgggccgaggatagatgtggaatggaag

SEQ ID NO: 50877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgggccgtgtactggggaggtgtgtgtg

SEQ ID NO: 50878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgggcctatacggggtcatggcctgata

SEQ ID NO: 50879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgggggacatgcaataggtagcatcgag

SEQ ID NO: 50880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgggtggacgatcatgtagagtgacccg

SEQ ID NO: 50881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggtccggtggggattgggttccacttc

SEQ ID NO: 50882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggtcctcgcttcagctgtatcgcggcc

SEQ ID NO: 50883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacggtgagaggaacgctctagtctgtcgc

SEQ ID NO: 50884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgtaggccggtggcagatattggctgtt

SEQ ID NO: 50885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgtgcagtggacatgtcgagtacggagg

SEQ ID NO: 50886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgtgcgaacagcagtagctcagcagttt

SEQ ID NO: 50887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgtgggcatgtggccgtttgacgacgtc

SEQ ID NO: 50888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacgttcgagattggggccgacttgcgctc

SEQ ID NO: 50889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactaacaccatgccgtgtcattagggctg

SEQ ID NO: 50890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactaagatagcggtatcaccgggctacga

SEQ ID NO: 50891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactaagcatcgtatagcatccaatttctg

SEQ ID NO: 50892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactaaggaagcccacggatggcgctcagg

SEQ ID NO: 50893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactaatattgccactgactttacacgtgc

SEQ ID NO: 50894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactaccctgacgccacaacggtcgctctg

SEQ ID NO: 50895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactagctcgacggcagcaaacaggtctgg

SEQ ID NO: 50896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactagtaggacatagtacgtgttgcgttt

SEQ ID NO: 50897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactagtctagctcagtgtgcataacactc

SEQ ID NO: 50898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactatagctgcggtacaagtttcggcctc

SEQ ID NO: 50899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactatcatgaccaggccatgtttgagtcg

SEQ ID NO: 50900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactcagccattcgtcgtctaacgcacgca

SEQ ID NO: 50901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactcgaaggagtcgggaacttcactaaaa

SEQ ID NO: 50902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactcgtttagaatcgggccgtggaagatg

SEQ ID NO: 50903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactgccagttgttcaagtgttgtgttcgt

SEQ ID NO: 50904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactgcgagtatcaaccaacggaggtgtcc

SEQ ID NO: 50905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactgcgccacgattcattcagggaaagtc

SEQ ID NO: 50906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactgcgtgggtattcgcgatcttccgctt

SEQ ID NO: 50907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactggcaagggacctttcttctccgagtg

SEQ ID NO: 50908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactgtcacataagaaatgccatccgcgtc

SEQ ID NO: 50909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactgtcttccggtcatatcgttcggcgtg

SEQ ID NO: 50910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacttaaaccatggttggaacgtgaatgtg

SEQ ID NO: 50911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacttaacgaagaaggtggcacgcgtatct

SEQ ID NO: 50912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacttaggggaatattatgacctggcattg

SEQ ID NO: 50913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacttgcaggttgctcggagccctttcgag

SEQ ID NO: 50914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggacttgcgatgcgtgcgagtgtgtcgaggc

SEQ ID NO: 50915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggactttgcccaagagcattgttgttagaat

SEQ ID NO: 50916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagaactcggatgtccagcgaaccgccacg

SEQ ID NO: 50917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagaatagccattaactctatatagtgttt

SEQ ID NO: 50918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagaatgtgcaggggaaacgagccgcactt

SEQ ID NO: 50919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagaattagaagttccggccccaaaacggt

SEQ ID NO: 50920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagacaccgggcaccacaagactgttgttg

SEQ ID NO: 50921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagacatccgattaggagtcggaaatcatg

SEQ ID NO: 50922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagacccgaaaatgactagttaagccaagg

SEQ ID NO: 50923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagacgctgattgccacactttttaccttt

SEQ ID NO: 50924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagacgggagacggggttggaccagtggta

SEQ ID NO: 50925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagactctatctcctagggtcaatttttga

SEQ ID NO: 50926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagagccgtttgtcatgagacttcccga

SEQ ID NO: 50927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagatcgctaaggccggatcctagcgtt

SEQ ID NO: 50928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagccgcacagctgcctggggtgacagt

SEQ ID NO: 50929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagcttgacattaaggccaggcccaccg

SEQ ID NO: 50930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagaggccgcaagtggtggcgatatgggtg

SEQ ID NO: 50931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagaggcggtgaatcccggcatcaggttcc

SEQ ID NO: 50932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagggacacttgattaagcagggctggg

SEQ ID NO: 50933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagggtgagcgtagtcgagcggtacttc

SEQ ID NO: 50934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagagtattttaccatcgttacgaccggcg

SEQ ID NO: 50935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagatagtaaacgcaggaagggtcctgcgg

SEQ ID NO: 50936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagatgggcggcaccctacggttgcgctag

SEQ ID NO: 50937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagatgtgcgcggccataagtaagccctcg

SEQ ID NO: 50938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagattagtcgggtttttgcgcccgatctt

SEQ ID NO: 50939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagatttcggacgtatgtacctaattgccg

SEQ ID NO: 50940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcacccttgtatacaatttttgcatcac

SEQ ID NO: 50941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcacttgagtccacgaggtaccatcgga

SEQ ID NO: 50942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcaggaagctaagctgcaaggtcatccg

SEQ ID NO: 50943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcagttaagtcgctgatatacctgtcta

SEQ ID NO: 50944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcatttgctgcctgtgacggtggttatc

SEQ ID NO: 50945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagccgacggacgatgctgacggtactgcg

SEQ ID NO: 50946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagccggtaacggtgtcatgcgggatgcgg

SEQ ID NO: 50947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagccgtgtccaaggggctctcaggttagc

SEQ ID NO: 50948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcctagcctcctgctattcctcgcttgc

SEQ ID NO: 50949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgatccggacaatgtcggttggggact

SEQ ID NO: 50950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgatgtgaaggttttgtgggctatagc

SEQ ID NO: 50951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgcaggacgacggtgcctagtggatca

SEQ ID NO: 50952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgcaggcattgtgtttcggcagacttc

SEQ ID NO: 50953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgccgactaagtctgtaccgccgtcgt

SEQ ID NO: 50954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcggccaaggataacataaggtcacctt

SEQ ID NO: 50955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgggacgtctgcagaggatgcgtaagg

SEQ ID NO: 50956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcgggtgcacattgcctgatgccacctg

SEQ ID NO: 50957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagctacaagggagtttattacacgataga

SEQ ID NO: 50958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagctagtcacatggagaaacgtttgtagt

SEQ ID NO: 50959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagctcgctatgcgtgatccttttccgtgt

SEQ ID NO: 50960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagctgctgtgtatgaccggtgcgtcgtga

SEQ ID NO: 50961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagctggtgtcatgccgtctcgctttaatc

SEQ ID NO: 50962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcttcagaggggaacgcaaaactgtaga

SEQ ID NO: 50963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcttcggtacttacggttagatctactt

SEQ ID NO: 50964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcttggacttgcttaattgccaccgccg

SEQ ID NO: 50965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagcttggcctcatgtctcatcttttgttc

SEQ ID NO: 50966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagctttagcaggtactcgttggtattgac

SEQ ID NO: 50967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggaacgggttctgggcggcttctcgtat

SEQ ID NO: 50968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggaagacttgggcgcgcggggcctttga

SEQ ID NO: 50969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggaatcaggactgcacaaaacttgaggt

SEQ ID NO: 50970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggacatggggttaaggttgaccttgctt

SEQ ID NO: 50971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggaccctcccgcacaagggtgaacagtg

SEQ ID NO: 50972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggacctcggccaacaagctcccgccccg

SEQ ID NO: 50973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggagagacggtcatctgtatcgtggact

SEQ ID NO: 50974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggagatgatttgtgtcagctaacggttg

SEQ ID NO: 50975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggagtcagggccagcgtgttttggctgt

SEQ ID NO: 50976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggatggtcgagttcatggatggaatgtg

SEQ ID NO: 50977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggatggtgccggcgctcgaacatcgctc

SEQ ID NO: 50978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggattcccagtcgggtttggtccattgc

SEQ ID NO: 50979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggcaaaccaacacgcactgccggtccga

SEQ ID NO: 50980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggcaaggattggcgccatcaggatcaca

SEQ ID NO: 50981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggccaccgtcattgaggggcgtcgcgtg

SEQ ID NO: 50982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggccgaactcacagaatagccgggttac

SEQ ID NO: 50983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggccggtggggtcatagacgctgatcaa

SEQ ID NO: 50984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggcgctcgtaatgagttgatcggtgtgg

SEQ ID NO: 50985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggctcgagaaccgcgaagtggcatggga

SEQ ID NO: 50986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggctctaggtgatcggttgtttggtact

SEQ ID NO: 50987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggctcttacttggatcgggtgaggtgta

SEQ ID NO: 50988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggctgaagctacatcgccaacaggtctt

SEQ ID NO: 50989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggatccatccacctggaatcgctgtac

SEQ ID NO: 50990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggatccgcgagtgatggctgatggccg

SEQ ID NO: 50991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggcagcggtggcagagtctgctcaggg

SEQ ID NO: 50992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggctcgggcgcgcgcaagtttctgact

SEQ ID NO: 50993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggctctttcggtttgttatagtgggag

SEQ ID NO: 50994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggggccggtgaacagccagcgcggacgg

SEQ ID NO: 50995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggggcgtaatctgtgtccactcggcaac

SEQ ID NO: 50996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggggctgccaagcggtattgtacatcct

SEQ ID NO: 50997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggtcaccgaatagttttacgcatataa

SEQ ID NO: 50998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggtcacgacttgcttgaaaattatgaa

SEQ ID NO: 50999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagggtccggatcagggttggacacttcgt

SEQ ID NO: 51000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtaagccgagggctgagttgcagttgg

SEQ ID NO: 51001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtcgagatgccagctcgtattgtattc

SEQ ID NO: 51002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtggcaaagtcctgagggaacagtttt

SEQ ID NO: 51003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtggctcacgtgattcttttaacaacc

SEQ ID NO: 51004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtgggagtggaggtaagtatttgatac

SEQ ID NO: 51005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtggtccgctccgccgcgggtttatgc

SEQ ID NO: 51006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtgtatctctggtcgccgcttcaccta

SEQ ID NO: 51007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggtgtccttagctctgtggcatcgggat

SEQ ID NO: 51008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggttcagcatccgtatcggcacccctgc

SEQ ID NO: 51009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggaggttcccgtgtgctttgtctgatacctt

SEQ ID NO: 51010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtacttgtctgccgccccccgcttgtgc

SEQ ID NO: 51011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtaggcacgtggcgttactggagctctg

SEQ ID NO: 51012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtataatgtagctgtctacggattaccg

SEQ ID NO: 51013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtatcgttcgattgtacagtggtaaccg

SEQ ID NO: 51014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtcacgcggcatcacccttttgaccttg

SEQ ID NO: 51015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtcattcagtgcgtttgtctgcggcgcc

SEQ ID NO: 51016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtccttgggaatctcgcgcagccacggt

SEQ ID NO: 51017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtcgggcctcgtcaaagcccacatgaag

SEQ ID NO: 51018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtctagtaggcataggaaaggcgaataa

SEQ ID NO: 51019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtgacgattgcgtttctcgatcatcttt

SEQ ID NO: 51020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtgattcgactaagcggagatggcatcg

SEQ ID NO: 51021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtgggcaagccgggatgcgacgggaacg

SEQ ID NO: 51022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtgggccagcggcttcttttcgaattgg

SEQ ID NO: 51023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttaattgactggcatagcatacgtgca

SEQ ID NO: 51024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttcaggtgctaaccactcgatctgtcg

SEQ ID NO: 51025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttcgatgtactgcctccaggttcgcca

SEQ ID NO: 51026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttctttccgtaagccgtgggcatgagc

SEQ ID NO: 51027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttctttggtcgtctatcctagggcccg

SEQ ID NO: 51028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttgcccttgcccgtgacgaggttggag

SEQ ID NO: 51029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagttggactcgttcttaatacccgaggct

SEQ ID NO: 51030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtttcacggatataaattccaccgtggc

SEQ ID NO: 51031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtttccgaggaagcatacgtcgaacagt

SEQ ID NO: 51032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggagtttgagtacacagtatatcgtacggga

SEQ ID NO: 51033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataaccacatcgatctggatggctagact

SEQ ID NO: 51034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataacgagccgaaagggactcatctggtt

SEQ ID NO: 51035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataagccatgatccttgatcgaacggtct

SEQ ID NO: 51036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataagcggtcctgcggtgaggcttttagc

SEQ ID NO: 51037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataatagtatttacctggagttgtggacg

SEQ ID NO: 51038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataatgttgtggcttcccgcgcttcaatt

SEQ ID NO: 51039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatacaacgtttggcgtagcttacctctgt

SEQ ID NO: 51040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatacagtcaattcaaacaaaactaagtcg

SEQ ID NO: 51041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatacatcggctattaccaccatactggtc

SEQ ID NO: 51042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggataccaattgcttcctcaggcaattggcc

SEQ ID NO: 51043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatacctccggttctctgctcccgtagtcg

SEQ ID NO: 51044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatacggaacgtgagtttacgagaatccgc

SEQ ID NO: 51045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatacgggtaagaagcaacaggtttgggtg

SEQ ID NO: 51046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatactagcgataatgtagggacgaatcgt

SEQ ID NO: 51047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagacaagctacttctccgtgccgagta

SEQ ID NO: 51048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagataagattaggcgacggacatacac

SEQ ID NO: 51049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagcatcggtccgtctccgataacgccg

SEQ ID NO: 51050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagcctaccgttaccaccaagcagcctt

SEQ ID NO: 51051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagcgctggtctattgaggtttgtccgg

SEQ ID NO: 51052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagcgttggggcgatcgttgagaggaca

SEQ ID NO: 51053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatagctctcaacgcaaatggggaatgata

SEQ ID NO: 51054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatatccggcggacatctgtatttcattgt

SEQ ID NO: 51055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatatgcacaggtggcctggtttgggggag

SEQ ID NO: 51056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatatggcattgcgctcggtatcagacgca

SEQ ID NO: 51057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatatggccaaccgccaaactgggctagct

SEQ ID NO: 51058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatattttgaagcattaagaggatactgat

SEQ ID NO: 51059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcacatgatttgtctgtgcctattccgc

SEQ ID NO: 51060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcacgcagtaatacgagggcgtcggccg

SEQ ID NO: 51061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcagatgcagtcaatgtgtggaggctac

SEQ ID NO: 51062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcagcacacgttttccaggccagaacgg

SEQ ID NO: 51063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcagggcgagaatacacgaacgagaggc

SEQ ID NO: 51064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcagggtgcgacggagcatgaaaactgc

SEQ ID NO: 51065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcaggttatactgcggtgtaccgtcgac

SEQ ID NO: 51066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcagtccgcgctgactgaggtgcttgta

SEQ ID NO: 51067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcagtgccgcccttgttgtctgtacccc

SEQ ID NO: 51068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcatggatattctcaattcagctcatag

SEQ ID NO: 51069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatccaaatttcccgccgtcttgatgccga

SEQ ID NO: 51070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcccagggatggggcgtgtacgatgcgt

SEQ ID NO: 51071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatccctccacgttaatcctttcgttatct

SEQ ID NO: 51072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatccttcctgcgatttagctagcgggatt

SEQ ID NO: 51073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcctttcggcaaggagacaccgccgtat

SEQ ID NO: 51074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcgcacgctacttagttggagtaggaag

SEQ ID NO: 51075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcgcgctttagttctccgtgtgtgcgtt

SEQ ID NO: 51076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcgcttctaacgcccgggaagtgcttgc

SEQ ID NO: 51077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcggaattcgatacgctcttaactagag

SEQ ID NO: 51078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcggccatacaaatggagtgggtagctt

SEQ ID NO: 51079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcggggaggagccatagccattgccaat

SEQ ID NO: 51080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcggtggccatcggtcaaatttccctgg

SEQ ID NO: 51081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcggtgtagccgcactgctctgagcagg

SEQ ID NO: 51082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcggttaatggatgttcctcaccctttt

SEQ ID NO: 51083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcgtctcagcatgctttgattagattgg

SEQ ID NO: 51084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcgttctgtgccatcgatcctcagttat

SEQ ID NO: 51085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcgtttgcgactcgactcttgggtgctc

SEQ ID NO: 51086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatctcgttttgcaggcattggtcacacgt

SEQ ID NO: 51087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatctgtagtgagcgggacacttagcccgc

SEQ ID NO: 51088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatcttagagcaaggatatgtcccaggcac

SEQ ID NO: 51089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatctttaccgcggactggcatcctattgg

SEQ ID NO: 51090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatctttttagcttagaataaattttccgt

SEQ ID NO: 51091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgacacaagcgccagcattgcaatgggg

SEQ ID NO: 51092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgacatggcggagagtagggtttcatcg

SEQ ID NO: 51093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgaccacgaactgtactacgggagtgaa

SEQ ID NO: 51094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgactaggataacggcaagagggcttgg

SEQ ID NO: 51095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgactccatcggccggtacctgcacggg

SEQ ID NO: 51096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgagtgtgcggctctgtgcgcctagacc

SEQ ID NO: 51097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgagtgttgcagatgggctgtcctgcgg

SEQ ID NO: 51098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgcagggcgacatttggacatgcacatc

SEQ ID NO: 51099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgccgtggtggtgtgtgcgttctttgtg

SEQ ID NO: 51100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgcgaatctgtacgatttgttagtacgc

SEQ ID NO: 51101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgcgcaggagattgcacaaggcgacggg

SEQ ID NO: 51102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgcgggcaacggtttgctgcgtgtgggc

SEQ ID NO: 51103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgcggtgcgctctcgactgtttgtgggg

SEQ ID NO: 51104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgcgtggccagtacgaggtgtgaactat

SEQ ID NO: 51105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgctcttcaaaccgcctctgcatggcgc

SEQ ID NO: 51106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgctttattctccgggcggctggacata

SEQ ID NO: 51107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggaggtcgaatcggtgccttggagact

SEQ ID NO: 51108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggcacacgttatcctctgcacgcccat

SEQ ID NO: 51109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggcacgacgcttggtccttggctactc

SEQ ID NO: 51110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggcagatatggagcaagcgtcgacatc

SEQ ID NO: 51111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggcaggtataggtgggggtggcatgcc

SEQ ID NO: 51112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgggagagaacgaactacgtgtgtctgt

SEQ ID NO: 51113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgggcagtaacggcggtcggaagtttgt

SEQ ID NO: 51114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgggcggttgatctggtaatatgcgtct

SEQ ID NO: 51115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggggctgaagttcgagtcttgtgttct

SEQ ID NO: 51116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggtacgtatgcagtcaaaggccacgtc

SEQ ID NO: 51117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggtggtgttcgtcgtagtttcactagc

SEQ ID NO: 51118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatggtgtccgaccgcaggcccgaagttcc

SEQ ID NO: 51119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgtagcttagctaattcctgacgacgcg

SEQ ID NO: 51120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgtatccgaggcccgcttctcacacccg

SEQ ID NO: 51121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgtgccggactcaaccatcgccgatcgc

SEQ ID NO: 51122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgtgcgggagatgttcgtccatcgaggg

SEQ ID NO: 51123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgtgctagacagagaccagggacacggc

SEQ ID NO: 51124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatgtggtgagacgcatggttgtgtcgcgg

SEQ ID NO: 51125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattaacgccaacctagtgtgggcagctcg

SEQ ID NO: 51126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattaataaggttgacattaacagaggttt

SEQ ID NO: 51127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattaattgctaatgtgctcgtccgcccgc

SEQ ID NO: 51128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattacaggtgggccttaggaagggggcca

SEQ ID NO: 51129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattacccagaaggtgtttcaactacagct

SEQ ID NO: 51130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattagacttaagagcagcgctttgcacct

SEQ ID NO: 51131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattcacgcttacgtttcatgcggtaagac

SEQ ID NO: 51132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattccgagatgatttacctgaacaatatg

SEQ ID NO: 51133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattctaccggcctgggactaggatgttcg

SEQ ID NO: 51134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattctcttgatttaccaacgtctggcaca

SEQ ID NO: 51135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattgacctcgcagacattctcggtttagg

SEQ ID NO: 51136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattgcgacagtcacctgagtgttctttcg

SEQ ID NO: 51137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattgcgatcacgaacttagtaatcctgcg

SEQ ID NO: 51138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattgctcggtgtgagacaaaccttcgtcg

SEQ ID NO: 51139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattggcgagccaggatggagcgatctgta

SEQ ID NO: 51140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattgggctagcgggattagaattctttac

SEQ ID NO: 51141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattggtagtcccgaaggggagtgggtgct

SEQ ID NO: 51142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggattgtagggagtaaacctaggaatcttct

SEQ ID NO: 51143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatttaagaaggtaaggttagaaaatcgcg

SEQ ID NO: 51144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatttacatcatgatgtcatacttctgacg

SEQ ID NO: 51145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatttacttacgtgtattcccactgcttga

SEQ ID NO: 51146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatttctatttgcacttggcaagcacactc

SEQ ID NO: 51147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatttcttcgctgtttccggttgctcaggg

SEQ ID NO: 51148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggatttggtgaatgggtcgcctgtgttctgc

SEQ ID NO: 51149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaaacacacgtcacgagcttttgggtgcg

SEQ ID NO: 51150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaaacgccagtcactatttggtctctttc

SEQ ID NO: 51151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaaactgagaccaagcagggggccaggtt

SEQ ID NO: 51152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaaagttgaaccactctttttttgttacc

SEQ ID NO: 51153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaaatgggatcacctcaccggcgttaggc

SEQ ID NO: 51154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaacattcaatgtgagggtgtgcttgcgt

SEQ ID NO: 51155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaacccacacttgcatcgggccgtttgtg

SEQ ID NO: 51156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaacggagggtgtaaaagtgcttccggtt

SEQ ID NO: 51157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaacggcgttggacgtagaactgatgtat

SEQ ID NO: 51158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagaatgaaaaggtagtagaggccgggt

SEQ ID NO: 51159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagactcgtaaggacaaagctgtgcgct

SEQ ID NO: 51160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagaggcggcctaccctgcgctttatga

SEQ ID NO: 51161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagccgaatgtggtccatataggtcaaa

SEQ ID NO: 51162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagccgtatgttaggtttcgtcaaacgg

SEQ ID NO: 51163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagcttttcgctttctcatctgcttaag

SEQ ID NO: 51164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaaggggggtgtttttagggtttagcgag

SEQ ID NO: 51165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagtataggaacatgcctttcacttaag

SEQ ID NO: 51166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagtgaggcgctaagtggatagctgtgg

SEQ ID NO: 51167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaagtgttcaggaggggagagaggtgttc

SEQ ID NO: 51168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatcacttaaactacttaccctcatgaa

SEQ ID NO: 51169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatcatgcctggcttacgttgagttttt

SEQ ID NO: 51170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatccaatgtggcaacactcgaccttca

SEQ ID NO: 51171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatctgtgggggccggtaagagtcctaa

SEQ ID NO: 51172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatgaatgattcaggattattattagtc

SEQ ID NO: 51173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatgacgaccctcgcgctagtggaacac

SEQ ID NO: 51174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaattgctgagcgtatgcagtctctgcaa

SEQ ID NO: 51175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaatttaagatacctatatccctgcgatg

SEQ ID NO: 51176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacaacataatccgcgcttcgttccgtgg

SEQ ID NO: 51177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacaacgtgtggtttgtgaagcggaagtg

SEQ ID NO: 51178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacaactcccgctgcatgtaccgctctat

SEQ ID NO: 51179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacaattatagatctgcttgtcgtgcctt

SEQ ID NO: 51180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacacatttctcattcaggcgtgtaagcg

SEQ ID NO: 51181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacacgagcgacttcggcaggcacaaatc

SEQ ID NO: 51182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacacgctgagatcaggccgtatggcagc

SEQ ID NO: 51183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacagtgctaggcgtcgtggagagaccac

SEQ ID NO: 51184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacatacggcagtccgtgaccgaattcct

SEQ ID NO: 51185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaccaactattgctaactgctcacctttt

SEQ ID NO: 51186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaccgatctctggcgtaaggtagcgggtg

SEQ ID NO: 51187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaccggtagtgtagctagcctgcctgatg

SEQ ID NO: 51188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaccgtcttggtcgcagcggttacatgcg

SEQ ID NO: 51189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaccgtgccaccaacgcgatggctgcttg

SEQ ID NO: 51190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaccttgtcggtctcgatctgtcaatatt

SEQ ID NO: 51191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgaggggtagactggatggcgttggat

SEQ ID NO: 51192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgcaccttgcattcggctatagagcga

SEQ ID NO: 51193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgcagcaagtttgtgtattcgttaggg

SEQ ID NO: 51194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgcatcgatgtgacgttagttcttacg

SEQ ID NO: 51195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgcgagttaggggacacagcacgcgga

SEQ ID NO: 51196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgcggcgttaaggtcctttaggctttt

SEQ ID NO: 51197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgcggtattggctaggggtatgtttcg

SEQ ID NO: 51198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacggacgtctcaggacaggttgtgtgta

SEQ ID NO: 51199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacggcgtgccggagcgagcgcggtgttc

SEQ ID NO: 51200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacggtcattcggggttacaagtgcgggt

SEQ ID NO: 51201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacggtcgaatgcactttccctggcggcc

SEQ ID NO: 51202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacggtcggtctacctaatggacttcgaa

SEQ ID NO: 51203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacggttacatagtgttttaacttggcca

SEQ ID NO: 51204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgtaaatgtctgcaccactgaacgttg

SEQ ID NO: 51205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgtagatgagcagcgggtttgagtgcc

SEQ ID NO: 51206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacgtcagcacgagtgttgttgtcaagcg

SEQ ID NO: 51207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcactatggcaacttgttagacagcaaggc

SEQ ID NO: 51208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcactattgaggtttgtcattaaccagggc

SEQ ID NO: 51209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcactctgtgaggactgtaggtggcggggt

SEQ ID NO: 51210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcactgatattatcgtaatacgggtcgggt

SEQ ID NO: 51211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcactgtcgtagcatcaagggttgttctct

SEQ ID NO: 51212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcacttggtcgggcctctctttggcggagg

SEQ ID NO: 51213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagaccgaaagtaaggttgatgcaagact

SEQ ID NO: 51214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagagatagtgcggtccagtgatggatat

SEQ ID NO: 51215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagagcatcccgtcaattgaacgcgcgag

SEQ ID NO: 51216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagagtgatacggcttggtcgaaattagt

SEQ ID NO: 51217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagataagtccctggaatgacacaactcg

SEQ ID NO: 51218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagattgcacattccagattttggatgcg

SEQ ID NO: 51219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcacactttgacctagattaggcgacg

SEQ ID NO: 51220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcacggtttaagtcagaacgatttgct

SEQ ID NO: 51221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcaggagcggtggatcaggctttggtg

SEQ ID NO: 51222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcaggattaactttggcgtaggcagcg

SEQ ID NO: 51223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcagggagcgtacgtatagccggaggg

SEQ ID NO: 51224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcatgcctaggtcgattgatgcgtcgc

SEQ ID NO: 51225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcattaattagtcgttcatacgtgtgg

SEQ ID NO: 51226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagccatgtgagtgccgtccagtgtttgt

SEQ ID NO: 51227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcccaagcaccagtcctcgtggccttc

SEQ ID NO: 51228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagccgtagggaagcccacgcaaaggtcc

SEQ ID NO: 51229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcgaccatgggtttcagcacgagggtt

SEQ ID NO: 51230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcgaccgacaccgcttgcgtgtaccgg

SEQ ID NO: 51231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcgctgatgttcactcctgatatctag

SEQ ID NO: 51232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcggccaaagggttctcctcgttagtc

SEQ ID NO: 51233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcgtgtgaacatcaagttgtcgggggc

SEQ ID NO: 51234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagctccatgatgtaacagtcgtgcccaa

SEQ ID NO: 51235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagcttgtagctcgcatattcaggggttc

SEQ ID NO: 51236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggatgcgggcgtggtatgatactgcac

SEQ ID NO: 51237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcaatgcagaatgtggtggtgccttg

SEQ ID NO: 51238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcaccgtccccattgagtggttgttc

SEQ ID NO: 51239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcatgcgagaaacagccgggggcgcg

SEQ ID NO: 51240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcatggggcggttgagatcttgccgg

SEQ ID NO: 51241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggccggaggtctttgacggggctgttt

SEQ ID NO: 51242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggccttgtaccagggttacactatgtc

SEQ ID NO: 51243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcgaacgggaacttttgaacatgtca

SEQ ID NO: 51244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcgcttgcaattgctacgggccataa

SEQ ID NO: 51245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggcggcataagggccagacccggcgtg

SEQ ID NO: 51246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagggaaagagtgtataagtcccttgacc

SEQ ID NO: 51247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggggtgtaagtgagtagttcgttggtc

SEQ ID NO: 51248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagggttttactcgtagcgagcggtgatc

SEQ ID NO: 51249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggtctttggcagggcatgtgcctcctt

SEQ ID NO: 51250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcaggtgaaatatgagcgcgtgccagtgcc

SEQ ID NO: 51251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagtaggatgaccagtacggagatgctcg

SEQ ID NO: 51252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagtcctcagcgtgtgggcttgtactcgc

SEQ ID NO: 51253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagtctacctcctacacctcctttggccc

SEQ ID NO: 51254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagtgcgattagtagatgtgccgaacacc

SEQ ID NO: 51255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagtgtttaaaaacgtactgcgtaaggag

SEQ ID NO: 51256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagttattatcgcgccactcggcccactc

SEQ ID NO: 51257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagttgcgtgattctgcgtataagctcat

SEQ ID NO: 51258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcagtttctgatgatacggtgtggcactta

SEQ ID NO: 51259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcataactcggtacgcaagatagcgcgaat

SEQ ID NO: 51260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcataagaatacccgtatacacgattcctc

SEQ ID NO: 51261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcataagcttagccaagggtactctcacgc

SEQ ID NO: 51262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcataaggcgtggtgtaaggcttgcaccgg

SEQ ID NO: 51263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatacaacggtggcattgccggactggag

SEQ ID NO: 51264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatacagcgtcaatttcgagttagtgtgg

SEQ ID NO: 51265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatacatatgaatctttggtgggaggatg

SEQ ID NO: 51266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatacctgttatcggatagggcgacttgt

SEQ ID NO: 51267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatacgggatgtttttgattgattttgag

SEQ ID NO: 51268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatactatcttccaatacgtaatcgacgt

SEQ ID NO: 51269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatagtaacgcggactatcttgtgctcgt

SEQ ID NO: 51270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatagtgcgcgactcatgtaacagttggt

SEQ ID NO: 51271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatatctttgggattggaacgttcgtagg

SEQ ID NO: 51272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatatttctcctcatcgccctccgaactc

SEQ ID NO: 51273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatcacggacaggtatttcaaacactggg

SEQ ID NO: 51274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatcactccacatcgctcttccctaataa

SEQ ID NO: 51275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatcaggtggttgtttaccgggacgtatg

SEQ ID NO: 51276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatccaagttgtttccgtattcaatcata

SEQ ID NO: 51277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatccaggcaaaaccgcagtcgtgccgct

SEQ ID NO: 51278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatccgtcgtcgctcatgccgcaaattag

SEQ ID NO: 51279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgaagagtgatgggttgaatgcatcaa

SEQ ID NO: 51280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgaccgatgcaacgcggtggtgggccg

SEQ ID NO: 51281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgactagtggtgaggaggatgaaagcg

SEQ ID NO: 51282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgatcataggccgactaggatacggct

SEQ ID NO: 51283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgattcgaatgaaccgtctacgcggcg

SEQ ID NO: 51284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgcaggcacatcgttgaccctgttccg

SEQ ID NO: 51285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgcatcactgaattgcggatctttagc

SEQ ID NO: 51286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatggcgcctaaagcatcgctatttgcgc

SEQ ID NO: 51287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatggcttgcggtgatgggtggtacgctc

SEQ ID NO: 51288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgggctcggcctgtataacccgcggag

SEQ ID NO: 51289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgggggctcttgtgccaggaccgtctc

SEQ ID NO: 51290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatggtcgctagtagcggtccgttactcg

SEQ ID NO: 51291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatggtgcggggttacaagagatcgcggg

SEQ ID NO: 51292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatggtgtgccaatggttccggtacctcg

SEQ ID NO: 51293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgtcaggggcagaataaaagaaacggt

SEQ ID NO: 51294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgttaactggtactcctggcaccaggc

SEQ ID NO: 51295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatgttcttcggacggtgggctgtaatcg

SEQ ID NO: 51296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattaagagggactcctgggctgcggcgg

SEQ ID NO: 51297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattaggggtgcgtgtccgacctgatgca

SEQ ID NO: 51298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattatgctgaggctctttgtggttcgtg

SEQ ID NO: 51299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattcgggagggctctcgaccgcatttcg

SEQ ID NO: 51300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattgacctattaccttggcagtagtcgg

SEQ ID NO: 51301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattgagaggtctggccgaacaggcagtg

SEQ ID NO: 51302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattgcactagaggcgtcgaggcgatagg

SEQ ID NO: 51303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcattgggctgttggtgcaaatgaatgtgt

SEQ ID NO: 51304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatttaggccagcctaactggacagcggt

SEQ ID NO: 51305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatttagttccacatggacgaagtgatat

SEQ ID NO: 51306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcatttccggcgaacgtatctcatctggcc

SEQ ID NO: 51307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaaacacagaccgcggaaactttcacgc

SEQ ID NO: 51308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaacagagacgcggattcccgacaccga

SEQ ID NO: 51309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaacatgggggcggtacgatcagatgcc

SEQ ID NO: 51310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaaggttacaatcgcttccgtcttcggt

SEQ ID NO: 51311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaataggggatcccgtaggttcgctgtg

SEQ ID NO: 51312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaatcgctcgatgtccgtgggttgagga

SEQ ID NO: 51313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccacaaacatgacgaggagcttaggttcc

SEQ ID NO: 51314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccacagtacatgttgtagtacaacccagg

SEQ ID NO: 51315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccacattaccgagctcgcgacacgttatg

SEQ ID NO: 51316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaccaaattggtgttcgctgccagcggt

SEQ ID NO: 51317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaccgcgctggtaaactagcgttcgtgc

SEQ ID NO: 51318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccacctccgtggttaggttatccggtgtt

SEQ ID NO: 51319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccacggcgaccttgatcttaggacctcgg

SEQ ID NO: 51320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccactatgccatttcaatcgagctgtggt

SEQ ID NO: 51321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccagcagtcagcacacgacctgtgacctg

SEQ ID NO: 51322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccagcggtgatcagttctatgaattccga

SEQ ID NO: 51323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaggactcccttactcggtggagggatt

SEQ ID NO: 51324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaggagcggtacgctggtggaacaggtc

SEQ ID NO: 51325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccaggcttctgcatgtgaaggggcgatcg

SEQ ID NO: 51326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccagtctgctcagccgtacttcttcattt

SEQ ID NO: 51327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccagtttgccggccgttgctgagaagttc

SEQ ID NO: 51328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccataacggccaaattcctttccgcaggg

SEQ ID NO: 51329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccatacactggcgttcgacgcgttcggac

SEQ ID NO: 51330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccatgacgcctactccgggtctgggttcc

SEQ ID NO: 51331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccatgcttatcgcgaaacccgtggcatca

SEQ ID NO: 51332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccatgttattccagcggctatttcgtggg

SEQ ID NO: 51333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccacttcgcatacgtggaatgtctcctg

SEQ ID NO: 51334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccaggagctctccctgttctggttctgt

SEQ ID NO: 51335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccgacagtggtgccaatacgggtttgaa

SEQ ID NO: 51336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccgacgtgcgcgagacttgggacatgct

SEQ ID NO: 51337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccgcagtcaagacggagaacgtgcaacg

SEQ ID NO: 51338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccgcgtctggacggcgtgacggtaggag

SEQ ID NO: 51339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccgcttagcagaatgacccgggtctcgt

SEQ ID NO: 51340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccggcgggaatcggcctgttaatgaggg

SEQ ID NO: 51341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccggtcctacacttgcgtacgttttgct

SEQ ID NO: 51342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccggtgggttgtgcgctatggaattagg

SEQ ID NO: 51343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcccgtcgggttgggtgccatagccgatcg

SEQ ID NO: 51344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccctcactattttgaatcgagaattctgc

SEQ ID NO: 51345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgaacagcatgatatgggccaaaccttt

SEQ ID NO: 51346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgaactattctcgcttaccggtcccatc

SEQ ID NO: 51347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgaagcgcgcaaaggggcactgatcggg

SEQ ID NO: 51348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgaatcgaggtcgcagtacagcgctgtc

SEQ ID NO: 51349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgagattttccctagccaggcgggcgct

SEQ ID NO: 51350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgagctgttggaaatcctgggggtgttt

SEQ ID NO: 51351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgagcttgccatcccacggactggaccg

SEQ ID NO: 51352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgagtcaccttctgtagttccacgtcga

SEQ ID NO: 51353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgagtgataaggcgttagcggatctgcc

SEQ ID NO: 51354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgataccgtgcatccgtgggtggggatg

SEQ ID NO: 51355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgattttagtcagtaatacatgtactgt

SEQ ID NO: 51356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcaaactcggtgcaccggggtgattct

SEQ ID NO: 51357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcagagtcacgggataccctttgaggg

SEQ ID NO: 51358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcagcgaaacccgtgcattttattgct

SEQ ID NO: 51359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcaggacttctgtgcagtgattacgat

SEQ ID NO: 51360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcccgggtttcgactgcaagggactct

SEQ ID NO: 51361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcgcagatacagaaagccgtaacagtt

SEQ ID NO: 51362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcgcttataagggttaccgggtcttat

SEQ ID NO: 51363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgcggctttgcgttgctcatggtatcga

SEQ ID NO: 51364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggacagggtctcgcggaatggtatgtt

SEQ ID NO: 51365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggagaggacaacaggcttcgcaggtgt

SEQ ID NO: 51366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggaggacacaagtctttagcttgcggc

SEQ ID NO: 51367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggcacagtcaaccgcgtgaatgcctgg

SEQ ID NO: 51368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggccatttgcagtcttacttgtgttgt

SEQ ID NO: 51369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggctggtaaccgagggtctgggcacgg

SEQ ID NO: 51370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgggattgcgggcttgggtgctggctag

SEQ ID NO: 51371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgggtcctcaccgtggcgctgtgaactg

SEQ ID NO: 51372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggtgaaactccgagcctcttgtttatc

SEQ ID NO: 51373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccggtgctgacccgtaactaagaaccgcg

SEQ ID NO: 51374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgtaccgagcactagattcagtggggtc

SEQ ID NO: 51375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgtagtttattatactgcggtggaagtt

SEQ ID NO: 51376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgtcgtgtcgccggagggatatgcccgt

SEQ ID NO: 51377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgttatgctaacccgttgtgcgttattc

SEQ ID NO: 51378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccgttcggtatgcgcgtatctaggttgtt

SEQ ID NO: 51379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctaccattgtcgtacaaaggcagtttcg

SEQ ID NO: 51380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctacccagcaagttacagtgccgtaggt

SEQ ID NO: 51381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctacctgtagtgatgcggagacgttttt

SEQ ID NO: 51382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctagttataattcggttgatttgggaga

SEQ ID NO: 51383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctatttgatgcgggtattgctcgtatcg

SEQ ID NO: 51384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctcacggttgggtttactggttgtcttt

SEQ ID NO: 51385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctcagaatgtcggcgggtagcctgagaa

SEQ ID NO: 51386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctcatgtaattcacacgccgacgccttc

SEQ ID NO: 51387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctcattacctgttaacagcgtggtcgtt

SEQ ID NO: 51388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctccctccttcggtgcactcaaccctcc

SEQ ID NO: 51389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctcggggtttaccagcaacttgagttag

SEQ ID NO: 51390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctcgtgtggactgggtaatagagcactc

SEQ ID NO: 51391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctctatgacatcgctcatcttctggtaa

SEQ ID NO: 51392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctctgggacgtctcctagcaacccatcg

SEQ ID NO: 51393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgaaaggatgtagttgttctcgggtcg

SEQ ID NO: 51394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgatatctcattttgggtggttcgagg

SEQ ID NO: 51395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgattcgagagttcctcgccctaaatg

SEQ ID NO: 51396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctggaccgtacgttatctatagcccata

SEQ ID NO: 51397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgggagttatacttccgacgcgaatct

SEQ ID NO: 51398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctggttagtgcacgtttccaagtggatt

SEQ ID NO: 51399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgtaactcgggcggtgggctgcagctg

SEQ ID NO: 51400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgtcatggtatgatcacagcttcgggg

SEQ ID NO: 51401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgtgacctggtaacggcgtgcgctcct

SEQ ID NO: 51402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcctgtggactgctttgaacatcgatggtt

SEQ ID NO: 51403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttaacagtatggtcgaagtagatgcgg

SEQ ID NO: 51404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttaacgttttcccgccactgggcagtc

SEQ ID NO: 51405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttacttcacgttttgctgatccggcta

SEQ ID NO: 51406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttagcgtggcgatcgcggtgctatgca

SEQ ID NO: 51407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttattgtgaagtggtcaggtagtcgtc

SEQ ID NO: 51408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttcacttcacagacgatgttagggcta

SEQ ID NO: 51409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttcctcacttttatttatcgtcgggtg

SEQ ID NO: 51410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttggacgtaatttgcaaattatagcct

SEQ ID NO: 51411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggccttggagcaagcggttgggtcggacact

SEQ ID NO: 51412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaaacctgaggcgtcgaagcggctccca

SEQ ID NO: 51413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaaatcccgcatctagcggcctaggtat

SEQ ID NO: 51414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaaatcgggtttcctcgccgggtccaac

SEQ ID NO: 51415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaaatctgtgtccaggcactcggcattc

SEQ ID NO: 51416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaacgtgagagaggaggtacgaattgag

SEQ ID NO: 51417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaactgtacacaacagactccggggtca

SEQ ID NO: 51418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaagaaccagtgatctgtcgtctcccgc

SEQ ID NO: 51419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaataaggaggtatgtgcgccgctacaa

SEQ ID NO: 51420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgacagggaatatcagtatcacggtcatc

SEQ ID NO: 51421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgacatgaggccgcgttctcatgtacggt

SEQ ID NO: 51422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaccctgcctctggggtattcggcacga

SEQ ID NO: 51423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaccgcaagatcccacgctactagaccg

SEQ ID NO: 51424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaccgcatgaggttggaaatggtactcg

SEQ ID NO: 51425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgacgcgttttacttggctcactcgtagc

SEQ ID NO: 51426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgacggcgaccttacatgcaccgggggtg

SEQ ID NO: 51427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgactaagcggggacgggattaagtgccg

SEQ ID NO: 51428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgagagggcgcccagccagcagtcagtcc

SEQ ID NO: 51429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgagatgaactgcgcagattctgtatcgg

SEQ ID NO: 51430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgagatgacctgcgcagcatccacctgga

SEQ ID NO: 51431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgagccacgaaaaccgagattgggggatg

SEQ ID NO: 51432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaggccaactacagtgtgcgtttcgggg

SEQ ID NO: 51433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgaggtgcaatgcgaacggaaggacggac

SEQ ID NO: 51434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgagtaccgccgttaaacagaggtgcctt

SEQ ID NO: 51435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgagtcggggataaggtgtggcagcgggt

SEQ ID NO: 51436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatacctattctgtagaggtggacttga

SEQ ID NO: 51437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatagctttgtgtctgacagtatcgagc

SEQ ID NO: 51438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatagtgtgtgatgaccccgattgcacg

SEQ ID NO: 51439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatattttttagttatcagacttttttt

SEQ ID NO: 51440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcactgttggatctggtcggtgccac

SEQ ID NO: 51441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatccaaagtttccgcgaaggagttcaa

SEQ ID NO: 51442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcgacgccactttacgcacgcccaat

SEQ ID NO: 51443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcgcgggaggcaagcacaatttcgac

SEQ ID NO: 51444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcgggggcgatattagtcttgacggc

SEQ ID NO: 51445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcgtccgtctcgtttagatatgcagg

SEQ ID NO: 51446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcgtgaggtcacagctctgcgcgggt

SEQ ID NO: 51447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatcttcatttttgcgtaagacccaatc

SEQ ID NO: 51448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatgacgtctaccaggctccgggtgggg

SEQ ID NO: 51449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatgattcgaagtttcgttctcagcgtc

SEQ ID NO: 51450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgatgcgtgtctcagatcgatcggttgcg

SEQ ID NO: 51451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgattggtcgaggcgatatttcatttcgg

SEQ ID NO: 51452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcaagcagaatgccgcgatcggtgaccc

SEQ ID NO: 51453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcacaggagtacattgacgttggtcagg

SEQ ID NO: 51454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcaccagtttaggatggttcgtgggccc

SEQ ID NO: 51455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcaccgggtcgactgtacttttgcttgt

SEQ ID NO: 51456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcacgcaagctgaatcgatcacgtgaaa

SEQ ID NO: 51457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcactgcccgactggctcgtggtatgtg

SEQ ID NO: 51458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcagctcggcaccggcacttgtgtaccc

SEQ ID NO: 51459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcaggggctagaacccgttatgctcgcg

SEQ ID NO: 51460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcagttgtggattcgacagctcgatgct

SEQ ID NO: 51461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcataagcgtgagctggtgaatctcagt

SEQ ID NO: 51462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcataatcttttcaatagcttcgactca

SEQ ID NO: 51463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcatattggcggctttaggttcgaaggg

SEQ ID NO: 51464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcatgccgagcaagcggtggttgtcatc

SEQ ID NO: 51465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcatggtatacgattgagcctgtagttc

SEQ ID NO: 51466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgccacgtgatctaacgacggtggactgc

SEQ ID NO: 51467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgccagtgtgtaatggattcggccttgga

SEQ ID NO: 51468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgccatgctggtactaaatcccttgtgga

SEQ ID NO: 51469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgccatgtttttcctaggtcttgagaaac

SEQ ID NO: 51470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcccaggtgatgtacccagctggcgatt

SEQ ID NO: 51471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgccctttcggtgactcgtgatggcggcg

SEQ ID NO: 51472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgccggggatttgcattatgcgcgcgcgg

SEQ ID NO: 51473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcctccatacccagggttggctaggggg

SEQ ID NO: 51474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgatggcggctcggcaactgcagacca

SEQ ID NO: 51475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgcaaacggtacgtgtggggttacagt

SEQ ID NO: 51476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgccttgagtcatggtaccagctacga

SEQ ID NO: 51477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgcgcactcgggtagccagggtttccc

SEQ ID NO: 51478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcggatgtagctttattacttggtggga

SEQ ID NO: 51479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcggggcaagacacatggcctctcgacc

SEQ ID NO: 51480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcggtggttgctctgcgagggcgcgagg

SEQ ID NO: 51481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgtagattggccatggtccgtgctata

SEQ ID NO: 51482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgtctctcggtttcttggaccctagta

SEQ ID NO: 51483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgtctgtaccctcatggcacgtacaga

SEQ ID NO: 51484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgcgttcggttctggcagggaatgacggg

SEQ ID NO: 51485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgctcagatcttcaccgtgcagcgtctta

SEQ ID NO: 51486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgctggcatcagggtggtcgaatacggcg

SEQ ID NO: 51487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgctttcagacaatagagagcaaggaggt

SEQ ID NO: 51488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggacaatgccctttcagctcattcattc

SEQ ID NO: 51489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggacaggcgtacctgtattcacgcagtc

SEQ ID NO: 51490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggacggtagactttcgtatttcagggct

SEQ ID NO: 51491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggactctttgctttgcgatacgtcttgg

SEQ ID NO: 51492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggagatcgaacaccctgtctcgacactg

SEQ ID NO: 51493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggagggcgggcatttgattgcgcgcgtc

SEQ ID NO: 51494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggaggggccggcgtatccgcatgagtgg

SEQ ID NO: 51495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcacagtacggttcctcgagcaagtgc

SEQ ID NO: 51496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcacgaatgtctgagtcgcgcacgtgc

SEQ ID NO: 51497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcacgtcaggtatacggctatatcaga

SEQ ID NO: 51498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcaggttcatccagttctcaccgttgc

SEQ ID NO: 51499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcagtggtatcgacctcggtttgtctt

SEQ ID NO: 51500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcatgaccaaccaaaggtcttgtcctg

SEQ ID NO: 51501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggccatgaagggggtgcaggtggagccg

SEQ ID NO: 51502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcccgacggttccattgcgtgccttga

SEQ ID NO: 51503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcccggggcaaaagataagcatacccg

SEQ ID NO: 51504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgagcgacgtatgcggtgcttgtcgg

SEQ ID NO: 51505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgaggcggttatatttgggtcccggt

SEQ ID NO: 51506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgggactcgtgttttcgtctcgcttg

SEQ ID NO: 51507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgtcacaattacggctcgattggtcg

SEQ ID NO: 51508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgtccgttttgtagggctcggactag

SEQ ID NO: 51509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgtggttgtagagggtccccattaac

SEQ ID NO: 51510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggcgtttacgtgttgcggtggatgcatt

SEQ ID NO: 51511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggctacggggcgatttattcacctgtgg

SEQ ID NO: 51512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggctatgttaaccgaagtggttgagaat

SEQ ID NO: 51513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggctccgtgtgtatttgtgccgctaccg

SEQ ID NO: 51514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggctcgggtgccaacaccttgggtttct

SEQ ID NO: 51515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggaaaccgttacgcgtagatgttgctc

SEQ ID NO: 51516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggactaggggtgatcataggtttaaag

SEQ ID NO: 51517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggagagtatcgatacattgtcaccgac

SEQ ID NO: 51518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggagccaaggcctgcagctgggtggcg

SEQ ID NO: 51519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggagctggagtgctcttggatatgcct

SEQ ID NO: 51520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggataaagggcgcggagactgtggtgc

SEQ ID NO: 51521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggataggcattacaacctgaaccgtgg

SEQ ID NO: 51522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggattactagagggacatctagtccgt

SEQ ID NO: 51523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggccacgcatttgggccacatgtaagc

SEQ ID NO: 51524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggcggaagtttagtcaccaacgtacgc

SEQ ID NO: 51525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggctgtgcgccgttgagttctgtgatg

SEQ ID NO: 51526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggggagcaggcgtaattgggtccctggt

SEQ ID NO: 51527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggggatcggctaggtgtgctgctccgcg

SEQ ID NO: 51528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggggacacgaggctatccacgatatgt

SEQ ID NO: 51529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggggggttcagaaggttatggtgggcct

SEQ ID NO: 51530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggggtggaccttggagggaggcagagt

SEQ ID NO: 51531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggggtctctgcggtgttaggatctgctt

SEQ ID NO: 51532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggggtgtttgttgactactcagttacgg

SEQ ID NO: 51533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggggtgttttttgcaggtacgtcgtgta

SEQ ID NO: 51534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtaactttttcagtccgttaccttcg

SEQ ID NO: 51535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtagttttatcgcgccggaacatctt

SEQ ID NO: 51536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtatttgcatcattacttatctcgcc

SEQ ID NO: 51537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtcagcgaacacgatcatttccccgg

SEQ ID NO: 51538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtgactcaccaccagggtattgtgcg

SEQ ID NO: 51539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtggacgactgactggagcatcacgt

SEQ ID NO: 51540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtgggaggatggaaaaaacagggcac

SEQ ID NO: 51541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtgtgtcttgtccgggttcttgtgta

SEQ ID NO: 51542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgggtttgggcaggacagccatgtgcgta

SEQ ID NO: 51543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtagggtgtaatcctgtagagaccggg

SEQ ID NO: 51544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtatcagcttgcgagattggacggccg

SEQ ID NO: 51545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtatcgagttcgatagggctatgcgac

SEQ ID NO: 51546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtcctgggatacacgagggccagagac

SEQ ID NO: 51547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtcgaagtgacctggcatcctgcttcg

SEQ ID NO: 51548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtcgctattcatggattcgtaagtagc

SEQ ID NO: 51549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtgatgccatgaactgtcccggcaatg

SEQ ID NO: 51550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtggcactcttcagcgtcctgccgatt

SEQ ID NO: 51551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtggccatgggttttttatcgctgcta

SEQ ID NO: 51552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggtggggtgagctgttacaactttgttt

SEQ ID NO: 51553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcggttggttagtcaggagcgcggagatgg

SEQ ID NO: 51554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtaacacgttacgtatcgatcggcgtgt

SEQ ID NO: 51555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtaagtggttcttagggactggtctaga

SEQ ID NO: 51556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtacattctatgacggcggcttcgttcg

SEQ ID NO: 51557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtactgaatcattgcgtgaggagtagcc

SEQ ID NO: 51558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtactgatcctggggatcgttcgtggag

SEQ ID NO: 51559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtagagcggtaatgtgacccccgacaac

SEQ ID NO: 51560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtatgtgctgtcttgcgtatttccatct

SEQ ID NO: 51561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtcacaggttgcttgagctggggaaggc

SEQ ID NO: 51562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtccggcaggcagttgggggtcagaggc

SEQ ID NO: 51563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtcgaagtgtggaacccaaacttctagg

SEQ ID NO: 51564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtcgaggtgagaactgtacacgtgcctg

SEQ ID NO: 51565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtcggatatactccatagagtatccagg

SEQ ID NO: 51566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtctctggtagacctgagtggtatggtc

SEQ ID NO: 51567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtctgatttatactatgaactatattga

SEQ ID NO: 51568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtcttcactacaaagatacagtagtggt

SEQ ID NO: 51569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgaacgggtcaactagtcgagggctcc

SEQ ID NO: 51570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgaactggtggacttttgtgggttcga

SEQ ID NO: 51571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgagcgatagcgtacgacgcgcgccga

SEQ ID NO: 51572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgcgagagtagggatcgttctggacgg

SEQ ID NO: 51573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtggacagtacggaatctctgtgggtgc

SEQ ID NO: 51574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtggcatgacgctccgaagtaaactgtc

SEQ ID NO: 51575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgggccaagttttgcgcatgttcgtgt

SEQ ID NO: 51576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgggcgaacaccggccatctaagccga

SEQ ID NO: 51577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgggcggataatggagggatgttcccg

SEQ ID NO: 51578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgggtgtaagccacaacatggagtagc

SEQ ID NO: 51579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgtgttccgtatacttgctattccattaa

SEQ ID NO: 51580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgttgaagggagttccctgggccggtgat

SEQ ID NO: 51581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgttggccgcggacggttagacgtgctgt

SEQ ID NO: 51582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgttgtcttgcaaccggtcggtctcctcg

SEQ ID NO: 51583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgttgtggggaagatcgttgctcgtgtct

SEQ ID NO: 51584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcgttttgacagatgtatctggtcgcgagc

SEQ ID NO: 51585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctaaagaggcaatatgggccgccagttat

SEQ ID NO: 51586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctaaccgagtgcggcgcgttccttcactc

SEQ ID NO: 51587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctaaggaggcaaccgcgactcttcacctg

SEQ ID NO: 51588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctaagtataatatccatgctgtaggtaca

SEQ ID NO: 51589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctaattctgccagacgtcgatccactgcg

SEQ ID NO: 51590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctactgtggtcatccctcgagccttggta

SEQ ID NO: 51591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagagactgcgtgctcgtgatatgacct

SEQ ID NO: 51592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagagcacggatgtgtctgttgactatg

SEQ ID NO: 51593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagccactagagctgatggcagaatttt

SEQ ID NO: 51594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagcctaatcgatcgtggctttctaaaa

SEQ ID NO: 51595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagcggcggctttagaagtccaagaagc

SEQ ID NO: 51596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagctcgacagggtggcagcaatcatcg

SEQ ID NO: 51597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctagtcataggaggttgtgtcatgcgttc

SEQ ID NO: 51598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctatcaacaagcacgacttgccggccaat

SEQ ID NO: 51599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctatcatgcagcgtacgaggtacgtttgc

SEQ ID NO: 51600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctatcttctgcaaccagccgtgggcttgt

SEQ ID NO: 51601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctatttgggggagtttgtttcgagatcgg

SEQ ID NO: 51602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcaaataacagttgtgttcgtgtcgggg

SEQ ID NO: 51603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcaagtttcttcctgctaccgtatactg

SEQ ID NO: 51604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcaatggattagtgttccgtatactctt

SEQ ID NO: 51605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcacgcgtgcagggaggtggatttctgc

SEQ ID NO: 51606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcagggctgcaaccgctcgtcggagtta

SEQ ID NO: 51607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcaggttggaggggtgtgttggacgtga

SEQ ID NO: 51608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctccaatagactaaataccaagcatccgt

SEQ ID NO: 51609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctccaatgattcgggttccaaagacaagg

SEQ ID NO: 51610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctccacggcgtcccgaatctgttatcgcg

SEQ ID NO: 51611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctccactccacgtgtgacggaaatggctt

SEQ ID NO: 51612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctccatgtgtagagtcgtgatggaacctg

SEQ ID NO: 51613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctccgaggtttgacatccgctgctccgtg

SEQ ID NO: 51614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcctgagcggaattttccacgcgcgtgg

SEQ ID NO: 51615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgaacgattgcagcaggatgcgctcca

SEQ ID NO: 51616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgattaagttggattgcttgagttgtc

SEQ ID NO: 51617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgcagtggcttcctcggtaggtgtctc

SEQ ID NO: 51618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcggagggcaccagatgtgttacaagtg

SEQ ID NO: 51619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcggcacattcgggcttatcgggtgacg

SEQ ID NO: 51620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgggcaaataatggttggggtggcagt

SEQ ID NO: 51621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgggtccaaagtgttcacttactgctg

SEQ ID NO: 51622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgtgggatagttctgatagtcatgcgg

SEQ ID NO: 51623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgttagactgaagtatggccttctggt

SEQ ID NO: 51624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctcgttgccctcattgctgtttgcacatg

SEQ ID NO: 51625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctctattggggtgcagcagctttacaggc

SEQ ID NO: 51626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctctctactgtgcaagaaactcctatccg

SEQ ID NO: 51627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctctgtcgctacaagaatgctgtgatcgg

SEQ ID NO: 51628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctctttctcgcaagtgtgtcgcgctgtcg

SEQ ID NO: 51629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctctttggatgacagcgaaagcaactccg

SEQ ID NO: 51630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgaagaacgacggcagcatcattcattt

SEQ ID NO: 51631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgaatagtaacatgcggcccccacaagg

SEQ ID NO: 51632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgaggtccgttgtaatcttaccgctgcc

SEQ ID NO: 51633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgataggacggatcttcgcgtcactcta

SEQ ID NO: 51634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgcaaccacgggtatctcgggattctct

SEQ ID NO: 51635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgcatcaatgagatactcatgatggttt

SEQ ID NO: 51636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgcatggaccgttggctagttacggctg

SEQ ID NO: 51637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgcattgctatcgctgaggtgctatgtg

SEQ ID NO: 51638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgccagcacgctcagcaactttactggt

SEQ ID NO: 51639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgccggaattgtcgccgcgactggcaaa

SEQ ID NO: 51640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgccttgatccagctcaaaataatgtcc

SEQ ID NO: 51641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgcgcagatcttgacgtcttagaaggcc

SEQ ID NO: 51642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgcgtcggctttgttatggcctgtgcgc

SEQ ID NO: 51643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggaatggcgtcgatcgtcgtactaggc

SEQ ID NO: 51644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggatggtactggcgtgatggaaatctt

SEQ ID NO: 51645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggatggttccacgttcggcggcaagcg

SEQ ID NO: 51646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggcattcggggcggttccgtgggtttc

SEQ ID NO: 51647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgggcacatatttattttgcgtttatcg

SEQ ID NO: 51648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgggcgatgtcccttctggatttttaca

SEQ ID NO: 51649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggtgaaacgacacgctaacggggatgg

SEQ ID NO: 51650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggtgattatacgaatcggtcatgggtc

SEQ ID NO: 51651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggtggcggtcctatcagttgctgtttt

SEQ ID NO: 51652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctggtgggcaatcaaccttcttcgtgtac

SEQ ID NO: 51653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtactaacttaacttctgccagaggtg

SEQ ID NO: 51654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtccgactgtactgcacgacggctgta

SEQ ID NO: 51655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtccgctatgggatacattccagtctc

SEQ ID NO: 51656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtcctgtaaacctgtgcgctgatcacc

SEQ ID NO: 51657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtcgaaacagactgtaagttgtgattt

SEQ ID NO: 51658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtctaaacaactaaggtctccgcggcg

SEQ ID NO: 51659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtggctagcttcctctcgtgcaacggt

SEQ ID NO: 51660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtgggactcgctcatgcatagtgtccg

SEQ ID NO: 51661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtggggggatcgtgataagtagaacca

SEQ ID NO: 51662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtggttttatacgtgcgtttggccttg

SEQ ID NO: 51663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgttcaacgatgcactaagttaccatgg

SEQ ID NO: 51664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgttgcgcaggctatgacaggattactg

SEQ ID NO: 51665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctgtttgagaacggctgggtctaggcgtc

SEQ ID NO: 51666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttaaagggcgtcggagaggggtaatgtt

SEQ ID NO: 51667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttaatttagtgactaccttatcatcgga

SEQ ID NO: 51668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttacgatataatttcgggcgtcgtgttt

SEQ ID NO: 51669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttacttgtttagattccagaaggcattg

SEQ ID NO: 51670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttatgtgtgtgcgaggctgcctttttta

SEQ ID NO: 51671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttattcggaccttgtgcaggggtacgag

SEQ ID NO: 51672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcaggggcagtcacagtctgagagggg

SEQ ID NO: 51673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcagtttgtctcatgtgattgctttgc

SEQ ID NO: 51674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttccacaaactatccggatctgatccat

SEQ ID NO: 51675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttccgtcggcctgccctgatctgtcaaa

SEQ ID NO: 51676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcgaagattcccaaacgcgtagaaagc

SEQ ID NO: 51677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcggcaggccagatatgattaagttgg

SEQ ID NO: 51678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcggcggtaggtctggtctacgcatgg

SEQ ID NO: 51679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcgtggtaagtctgctgcgggagttgc

SEQ ID NO: 51680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcttcacgtacatgtgcagtgttcctc

SEQ ID NO: 51681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttcttgccgacacaacgtcctgccgtct

SEQ ID NO: 51682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttgcatgcaggtgttgatgcatgtgcga

SEQ ID NO: 51683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttggaatgaagtagtgagatatttgtgt

SEQ ID NO: 51684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttggacgacgcagacgtgccacgatgcc

SEQ ID NO: 51685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttggatacctccgcgttactgcatgggt

SEQ ID NO: 51686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttgggtacggtaggggaatgtgtccgcg

SEQ ID NO: 51687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttggtggtcacgggcgtacatacaaatc

SEQ ID NO: 51688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttgtatgcttcacgtcaacctcatgtga

SEQ ID NO: 51689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctttcagaagaggtctcttatacactgcg

SEQ ID NO: 51690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctttgagtgttaggtggaacccgtcgcag

SEQ ID NO: 51691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctttgagttggcccgatccatatgttcct

SEQ ID NO: 51692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctttggtgttgtccgcgtgagccatgggt

SEQ ID NO: 51693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggctttgtgtgggcttcctgatgttagaggg

SEQ ID NO: 51694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggcttttactcgcattagttaatacgcaccc

SEQ ID NO: 51695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaaaggcccacaatttcgagtgctggtgg

SEQ ID NO: 51696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaaatggatatgggagattttagacacaa

SEQ ID NO: 51697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaacacagcgatacgccgcagcttgcagc

SEQ ID NO: 51698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaacacgtgtgtcttcggtagaccctatt

SEQ ID NO: 51699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaacaggctgggataacactgcgctcatg

SEQ ID NO: 51700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaacatatctattgactcgcagggttgcg

SEQ ID NO: 51701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaacgccgtcgtggggacgtacgcggtcg

SEQ ID NO: 51702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaactgtttatcttattggcttccgccac

SEQ ID NO: 51703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaagcgatgttgggtaggttccgtttatc

SEQ ID NO: 51704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaaggaacgaggtgacgtggatatatctg

SEQ ID NO: 51705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaaggcttttacgagcatttgggcgcaac

SEQ ID NO: 51706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaagtgcaactgtacccgatgcccgtcgt

SEQ ID NO: 51707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaataacgcgctggaggggcttgtggcgg

SEQ ID NO: 51708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaatctcgtccgtttcggcatccgtcggc

SEQ ID NO: 51709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaatgcttatgatatactgggtcgcgggt

SEQ ID NO: 51710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaatgtctctagcgcgcaacagtcgttcg

SEQ ID NO: 51711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaattgcttgttattggggggttgagttg

SEQ ID NO: 51712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaattgttggctcagagcggtccgggtcc

SEQ ID NO: 51713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacaaattgtgggtacgagggatttggta

SEQ ID NO: 51714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacaagttctctctgggggggtctgacga

SEQ ID NO: 51715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacacgtatctagatgagtcaatggtccg

SEQ ID NO: 51716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacactgccatagaacatgcaacgatagt

SEQ ID NO: 51717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacagaagcgtttggactcttggtacgga

SEQ ID NO: 51718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacagccacccagaggtacgttgcggatt

SEQ ID NO: 51719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacagggtggtaaatcgtgagcgtgtgga

SEQ ID NO: 51720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacagtcttacgctgggggtgtggtagct

SEQ ID NO: 51721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacatcggttatcacccttcttcagtcgc

SEQ ID NO: 51722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaccaaagcagcggcgtctctcagaacgc

SEQ ID NO: 51723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaccacggttctaatgcttccgaccccga

SEQ ID NO: 51724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacgagctgggtccctatttcccgtttct

SEQ ID NO: 51725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacgccatcagaggtgcgtatcgacccga

SEQ ID NO: 51726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacgcggtgcgacacggtctggtaaccgg

SEQ ID NO: 51727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggactgccttgcaacgggcgtttgct

SEQ ID NO: 51728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggaggtggttaatcgcgacggcgtct

SEQ ID NO: 51729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggcgcaaaacgccaagcactggttgg

SEQ ID NO: 51730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggcgtgcgagtggctcttgcttaccg

SEQ ID NO: 51731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggctatatccctcgggaagacagtag

SEQ ID NO: 51732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggggaaaactcggacgcagcaaggga

SEQ ID NO: 51733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacggtagaggagcggcaggttgtgcgca

SEQ ID NO: 51734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggacgtcccatctcaacaccacccgatgcg

SEQ ID NO: 51735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggactcacatcgtaaagaaaccggaactcc

SEQ ID NO: 51736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggactgctaagacttttgatctctggtcat

SEQ ID NO: 51737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggactgctaatagcgccgtttagatctggt

SEQ ID NO: 51738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggactgcttggtcttgaggtgtttcgtctg

SEQ ID NO: 51739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggactggcgggcgccgacggattcgtgcgt

SEQ ID NO: 51740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagacgcccagactcgcgtgctcgggtgt

SEQ ID NO: 51741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagacggcggacatagcctagtgttgaac

SEQ ID NO: 51742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagactacaggcttgggtgaggagctatc

SEQ ID NO: 51743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagagggttggtggtatcgagggtgtgtt

SEQ ID NO: 51744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagatcgccggactagtgatccttgcgct

SEQ ID NO: 51745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcacgctactgcagtactgttggcggt

SEQ ID NO: 51746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcagacgcgaatctagagtttgcgtta

SEQ ID NO: 51747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcattacggaattaggccggtgttctt

SEQ ID NO: 51748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagccatatgttgtcatgttagatcatgc

SEQ ID NO: 51749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagccggacttgtgtttgatggacattgt

SEQ ID NO: 51750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcgctcagttccggggtgaaaaagatg

SEQ ID NO: 51751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcggccgtcgtaaccccatggcgagac

SEQ ID NO: 51752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcgtcgcatgcacgtgatggggtcggc

SEQ ID NO: 51753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcgtgggattcaatgacaactcggagc

SEQ ID NO: 51754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcgttaaaagggtcggtagtgtgactg

SEQ ID NO: 51755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagctggtgcaacatctgggttggtctat

SEQ ID NO: 51756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagctgtaggcccggtgctggatagtctt

SEQ ID NO: 51757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagcttcaatcggatggggccagtgccga

SEQ ID NO: 51758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaggataacacggttttaggtgccgccac

SEQ ID NO: 51759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaggcagaccaggccagtgttgacaagcc

SEQ ID NO: 51760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagggagccgtgattcaagggtagatgtt

SEQ ID NO: 51761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaggggcgggatgtgcgaggaaaagattg

SEQ ID NO: 51762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaggtcactgaaccgtataaagccggccg

SEQ ID NO: 51763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggaggtggaggtggaggccctgcatctggg

SEQ ID NO: 51764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagtaaatgagttgggtcaatttttgata

SEQ ID NO: 51765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagtgacagcgagcagcgaacttagcctt

SEQ ID NO: 51766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagtgaccgcgcgccgcaacgttcggaag

SEQ ID NO: 51767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggagttttcggtacttgccgacgcctctct

SEQ ID NO: 51768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatacgatgtgcgcggtaacggtgggctc

SEQ ID NO: 51769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggataggaggtgtgtccgtgaatgccgagg

SEQ ID NO: 51770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatatcgggtgggtttagcagggattatg

SEQ ID NO: 51771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatatgtagttactttgatagggcaaggg

SEQ ID NO: 51772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatcaaggggttaatccttgtgagtgagg

SEQ ID NO: 51773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatcacgtgccgcgtggcttcctttcttc

SEQ ID NO: 51774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatcctttgcttcaattcaggacttatct

SEQ ID NO: 51775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatcgaaatattgtttggtccttggcgga

SEQ ID NO: 51776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatgaggttccgcggtttcgcttctgagg

SEQ ID NO: 51777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatgattcgcggcctaccatggtttcctc

SEQ ID NO: 51778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatgcgacataaacctgaagccactcgtc

SEQ ID NO: 51779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatgctgtgtgtacctggagtcggtccac

SEQ ID NO: 51780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatggtgttcaatctggtttgtatcattc

SEQ ID NO: 51781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggattacacgcacaataacagtgttccagg

SEQ ID NO: 51782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggattagcgacgattccatgccgcggggct

SEQ ID NO: 51783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggattagggaacattcactagtgactgtca

SEQ ID NO: 51784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggattgcacataagggtcactgattggcgg

SEQ ID NO: 51785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggatttctaagtgatcaggcaggccgaggt

SEQ ID NO: 51786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaaacttggctcattccactgggccgtg

SEQ ID NO: 51787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaaagcagtggggtggtgtgcgcgttaa

SEQ ID NO: 51788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaaaggttttccacgcacaactgtaagc

SEQ ID NO: 51789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaacagggcgacgtggcagttctctcgg

SEQ ID NO: 51790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaacgcagttatcctaacccaaaaggcg

SEQ ID NO: 51791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaaggctggcgaaatcgatgtgtccaag

SEQ ID NO: 51792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcacaactcaattccagcggtttcctgag

SEQ ID NO: 51793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcacaagagggttgcctatttgcgctttt

SEQ ID NO: 51794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaccagacacgcaataacggcctgcgct

SEQ ID NO: 51795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaccggtatgttgcccttagcttgatat

SEQ ID NO: 51796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcacctgtttgcgctgacctgggtctccg

SEQ ID NO: 51797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcacgcgattaagttcgtttgattcggcg

SEQ ID NO: 51798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcactcgaacgggttaaattcaatttccg

SEQ ID NO: 51799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcactcgtccaagtgtgtgatgcttaacg

SEQ ID NO: 51800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcactggctttggggttacgctacttgtc

SEQ ID NO: 51801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcagagcaccacctatcggcacattgcgt

SEQ ID NO: 51802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcagagtgactcttggttctgagtgggag

SEQ ID NO: 51803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcagcaggaccggggaagagagtcggtcg

SEQ ID NO: 51804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaggtaacagcagacaccgtgtaatcgc

SEQ ID NO: 51805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcaggtggccagttatcacactatggccg

SEQ ID NO: 51806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcagtttgggccattccctaactcggcgc

SEQ ID NO: 51807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcatacaactcggatgtacatggagcctc

SEQ ID NO: 51808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcatcgtgctctggactcccccagacggg

SEQ ID NO: 51809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcatctccagcgcagagtggttcgagtac

SEQ ID NO: 51810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcatgggtagcagcaacacagctgtcggc

SEQ ID NO: 51811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcattgcccagtaatgcggccgatcagct

SEQ ID NO: 51812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccaactgcgaagtcaatgaccgtgtgtt

SEQ ID NO: 51813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccaaggcgattgcctcccgcatcctacc

SEQ ID NO: 51814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccacttgcacgatcgcaacggggctcta

SEQ ID NO: 51815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccagagattgtagactgtagtgttttcc

SEQ ID NO: 51816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccaggatccgctcaggtaagtgttggat

SEQ ID NO: 51817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccagtatccggatagggccaacagtcta

SEQ ID NO: 51818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccagtcctcagcaccggtccttcacaat

SEQ ID NO: 51819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccatggtgtgagcaaatctcttcagatc

SEQ ID NO: 51820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcccaatccggtcggttcctgtccacagt

SEQ ID NO: 51821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcccgcatcgctcttcaggtagtttcgtt

SEQ ID NO: 51822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcccggtcctggagctcatagtctcctgt

SEQ ID NO: 51823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccctacgaagccgacttcagactctgaa

SEQ ID NO: 51824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccctagcagctcaacatcgcttgttatc

SEQ ID NO: 51825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccctggacattacattgcctgcttgcta

SEQ ID NO: 51826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccgaaaagtgtggggtttcagttgtcgg

SEQ ID NO: 51827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccgcaaaaatcgctgaagcgacgcatag

SEQ ID NO: 51828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccgcacgtcacgatcccaacattaacga

SEQ ID NO: 51829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccgctatcaagctgcttacgcatgtccg

SEQ ID NO: 51830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccggatcgcacttttacgatgtttgtat

SEQ ID NO: 51831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccgggcttccgtcgaggtgtgcacctac

SEQ ID NO: 51832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccggttgtagatacatcggtcagtaggt

SEQ ID NO: 51833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggccgtgcatgattgggcgacacgttgtgt

SEQ ID NO: 51834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcctgatcggtcacaactgacggttccgg

SEQ ID NO: 51835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcctggcggatttgcctagttgttcgtgt

SEQ ID NO: 51836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcctggtatcgttggcgcgcttcgggaat

SEQ ID NO: 51837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcctgtggcggatacaatgctcggagtac

SEQ ID NO: 51838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcctgtgtccgcaaccgactagtgctcgg

SEQ ID NO: 51839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgaaatgacggatgacggctatctgtcc

SEQ ID NO: 51840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgaagcggacgcgtgacgaacccgactt

SEQ ID NO: 51841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgaagcggtctgatccgttgtcattggg

SEQ ID NO: 51842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgaagcgtactctgcatcgacgactgca

SEQ ID NO: 51843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgaatggaaccggtaagcgaggccgagt

SEQ ID NO: 51844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgagcacgggattcgaattagagtggtg

SEQ ID NO: 51845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgagtagttcaccctatggcagcccgct

SEQ ID NO: 51846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgagtggcagccgtgcgaagccagagtt

SEQ ID NO: 51847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgatgtctgccgcttcataagtttcgga

SEQ ID NO: 51848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgattaattaggacttgcacattccgtc

SEQ ID NO: 51849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgcaaggaacccttcgacaatggggcgt

SEQ ID NO: 51850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgccagtatttattcgtctatgggcacc

SEQ ID NO: 51851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgccctgtctaaggcgtgcttgttcccc

SEQ ID NO: 51852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgcctgcgaggtttgtagattgtgtggg

SEQ ID NO: 51853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgctggacgggtttgttcttgaacgacg

SEQ ID NO: 51854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggagcatatccttttttgtccggggtt

SEQ ID NO: 51855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggagtattgaggcaattctcatcttac

SEQ ID NO: 51856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggatcctaggaaagagtattttatggt

SEQ ID NO: 51857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggatggagaaagttattggattgtggg

SEQ ID NO: 51858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggccctgggaatcaccggggtaatagg

SEQ ID NO: 51859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggccggtttcagggaactgtcctgttg

SEQ ID NO: 51860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggccgtatagggcgggcaacaggatga

SEQ ID NO: 51861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgggccaatcaccacagcgccataccgg

SEQ ID NO: 51862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgggcgtcgggttattgtggacacagct

SEQ ID NO: 51863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggggtaccgattgatctttaccatgtg

SEQ ID NO: 51864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggggtcgactatccagtagcacacctc

SEQ ID NO: 51865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggtacggagcttgcgtggggaatcagg

SEQ ID NO: 51866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggtccggactctttccgccgtgggtac

SEQ ID NO: 51867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggtctcactgtgtgggttgaagggtcc

SEQ ID NO: 51868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggtgcgcgggcgaagcgagtgagattg

SEQ ID NO: 51869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcggttcacgatggccacgagactctctt

SEQ ID NO: 51870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgtaggcgctgtacgtcacaaagcgcgg

SEQ ID NO: 51871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgtcaggtaggggactaatgaggcgagc

SEQ ID NO: 51872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgtcatatacccaagaaccggaacgggc

SEQ ID NO: 51873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgtcctcgggtcagaaccctctaccgct

SEQ ID NO: 51874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgtgggagatggcggttcctgaaagtgt

SEQ ID NO: 51875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgttcacggggccggcaagcttaatttc

SEQ ID NO: 51876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcgttcgatggttgttctgtcggggcagc

SEQ ID NO: 51877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctaacttgggcggatgagcgttcacccg

SEQ ID NO: 51878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctaagtgatacccaggacagcttgatca

SEQ ID NO: 51879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctaattgtccgactgtgcaacaaacgca

SEQ ID NO: 51880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctacgggatttctaataccaggtgcatc

SEQ ID NO: 51881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctagaggaacctgcctgcatccaccggc

SEQ ID NO: 51882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctagctgtttcgaagttggggtacggcc

SEQ ID NO: 51883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctaggggagcaagtacacgtggacgacg

SEQ ID NO: 51884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctatctctccgactgtgtacaacccctg

SEQ ID NO: 51885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctatggccataggtgcgtcttaaatggc

SEQ ID NO: 51886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctcacgctagtagttcaattgccttggg

SEQ ID NO: 51887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctccccatgcacgctgctggtaacatgg

SEQ ID NO: 51888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctcccttcgacatggcaaaacgcctaca

SEQ ID NO: 51889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctcgacacacttacatttgtgctgctgt

SEQ ID NO: 51890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctcggtatagtgctcatcgcacggctcg

SEQ ID NO: 51891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctcttactccggcaagctgtcatgtcca

SEQ ID NO: 51892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctgaatgggatgactatgggtcgccagt

SEQ ID NO: 51893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctggacgaccaccaaggggactaatgac

SEQ ID NO: 51894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctggatgctgtggcgtagcttctcgctg

SEQ ID NO: 51895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctggcacagctctgaggtatcgggctcg

SEQ ID NO: 51896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctggcccagaaatgcaaccaggaggcgg

SEQ ID NO: 51897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctgggacggcggcaagagctgatttgct

SEQ ID NO: 51898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctggtcaactggccgtagtttatcttct

SEQ ID NO: 51899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctggtggctggtgacagcttgctgggac

SEQ ID NO: 51900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcttaaggacacgcattgacgggacagca

SEQ ID NO: 51901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcttctcgcgtaaattgctgcgccgtgat

SEQ ID NO: 51902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggcttgtagcatcgatggggttcggcacgc

SEQ ID NO: 51903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggctttcctacggtagctctctggccaatt

SEQ ID NO: 51904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaaacactcaaaggccccgttggtcctc

SEQ ID NO: 51905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaaatggcttccacgtatggatttcctg

SEQ ID NO: 51906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaacaacgatggacctggataccgcagg

SEQ ID NO: 51907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaaccactgtacgtagtgcacgcctggc

SEQ ID NO: 51908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaaccgcgcctggagcagctcgttgggt

SEQ ID NO: 51909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaacttacggcgctcggacagtggctgt

SEQ ID NO: 51910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaagcataacttcattcagttctacatg

SEQ ID NO: 51911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaagcctggtgatacttgtcgggcctgg

SEQ ID NO: 51912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaagctgccggacgctcgatgaggtcgt

SEQ ID NO: 51913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaaggtggcggtacagtggtctagatat

SEQ ID NO: 51914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaatacccgctcccttgcacggggcagc

SEQ ID NO: 51915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaatccgggaatttctctggatttatca

SEQ ID NO: 51916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaatgatgaaaaagcgcccatggggtga

SEQ ID NO: 51917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaattcctccggagtcatgcgtggtacg

SEQ ID NO: 51918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaattcgatgcgagtgatgagaggcacg

SEQ ID NO: 51919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacacggaatagtgtgtctcggagcgat

SEQ ID NO: 51920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacacggggggcctcgtttgatcgactc

SEQ ID NO: 51921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacgcagatggggggctcaagtctcgca

SEQ ID NO: 51922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacgcgttatatggttcggttccttcta

SEQ ID NO: 51923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacgctgatgcaggacaggaatggttga

SEQ ID NO: 51924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacggctctggagaatccggggacgagt

SEQ ID NO: 51925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggacggtggcaatagatagtgctcacgct

SEQ ID NO: 51926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggactcctcggtttgaaagttacaagggc

SEQ ID NO: 51927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggagagagatatcgtacggaccagctgcg

SEQ ID NO: 51928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggagatgttgcggaatatgccggcatccc

SEQ ID NO: 51929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggagcgatatggagcgcgacgtgtctcgt

SEQ ID NO: 51930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggagcgcctagttagcacagggcgaattc

SEQ ID NO: 51931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggaggctctggagcgtgccgtttattagg

SEQ ID NO: 51932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggagggctccgagcgctttttgaggtttt

SEQ ID NO: 51933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggatattcatcttatggatgcgccatact

SEQ ID NO: 51934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggattccggcccgttgttcgttgaatata

SEQ ID NO: 51935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcaacgtgaacggcttaattgggcttag

SEQ ID NO: 51936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcagcagcctgggagtaggggaagtcct

SEQ ID NO: 51937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcataggcaacatgtagcgtgacgtatc

SEQ ID NO: 51938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcatcacgttgtatacgacccggacgtc

SEQ ID NO: 51939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggccaagcagggggagctgtttagagcgt

SEQ ID NO: 51940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggccaaggtttgttgtgcctgtgcggtac

SEQ ID NO: 51941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggccatagaggagggcgttgcatggaggt

SEQ ID NO: 51942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcccaaatgcaatgggggcatcgcttcg

SEQ ID NO: 51943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcccgtctctctgcgagcgtataggctt

SEQ ID NO: 51944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggccgataggttgatatgcgactatccgt

SEQ ID NO: 51945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggccgctccacccatcgatcgttggtatg

SEQ ID NO: 51946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggccgcttcacttgctcggtttaatccga

SEQ ID NO: 51947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcctggaaaccatgatagtctttggtgc

SEQ ID NO: 51948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcggaacggtccgtggggtcaggtggtc

SEQ ID NO: 51949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcggctcagctcaaccgacccattccgt

SEQ ID NO: 51950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcgggcttcatcaagtagccgtgagtga

SEQ ID NO: 51951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcggggagacatgaactgacggaaccgg

SEQ ID NO: 51952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcgggtcgtcaggatgtgcatcgctctt

SEQ ID NO: 51953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggcgttatgacattgcgcgctgtgttgca

SEQ ID NO: 51954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggctaaagtgatagtgttgccgtccggaa

SEQ ID NO: 51955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggctatgatcgctctacaacggtgagggc

SEQ ID NO: 51956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggctcagcaatctctgttttcgatgcgaa

SEQ ID NO: 51957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggctgaacgtttggtgaacagtcatattc

SEQ ID NO: 51958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggctttttcgggtctgattcaaggttgcg

SEQ ID NO: 51959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggaattggtgttgggaacagtgtgacgt

SEQ ID NO: 51960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggacactgtgcgggccgatcggcgtggt

SEQ ID NO: 51961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggagggcacataggaaccgtttttaatg

SEQ ID NO: 51962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggatcgcgggaactgcctcgaagatagt

SEQ ID NO: 51963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggattgttaagtttgtgcgcgtccacat

SEQ ID NO: 51964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggcatgtgtattatcgcaccggtacgtg

SEQ ID NO: 51965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggccctggttgttcctatatctcgttct

SEQ ID NO: 51966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggcgtcggtgcggtccgtaatgcgagcg

SEQ ID NO: 51967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggggcagacgctgctcccaacgttctgca

SEQ ID NO: 51968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggggcgattgcctatctgggaccgatcac

SEQ ID NO: 51969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggggctagctgactgcacccgtcatcgtg

SEQ ID NO: 51970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggtccgccacgctaagcgaccgttgtaa

SEQ ID NO: 51971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggtcgcaggagttatgacagaacgcagc

SEQ ID NO: 51972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggtggagagctttgcgcgcggggataca

SEQ ID NO: 51973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggtggggatccctacgctttacactccg

SEQ ID NO: 51974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggggtgttgccctctagcccgttccaccga

SEQ ID NO: 51975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtaccctagcctgtcaggtcttcgagag

SEQ ID NO: 51976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtatcacggtttgcacttcccgcataac

SEQ ID NO: 51977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtcatggtgaactatggttgagcgttga

SEQ ID NO: 51978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtcgttggacgtatcgggtaccggctcg

SEQ ID NO: 51979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtctagttagggggcctaggacgattcc

SEQ ID NO: 51980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtctccgcagccatgtttcagccctaac

SEQ ID NO: 51981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtgacgcagcgggcaactcatcggcagc

SEQ ID NO: 51982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtggagattctctgattcgaagaatgtc

SEQ ID NO: 51983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtggggacacgatcgattgttcagcggt

SEQ ID NO: 51984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtgtggacgagaagtgcgccggcatgat

SEQ ID NO: 51985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggttaacagggcgtaagcgttaccatgcg

SEQ ID NO: 51986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggttacgatgaggcacgtccgtttgctgg

SEQ ID NO: 51987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggttctgtgcctaattggctttagttctg

SEQ ID NO: 51988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggttcttcgcttcgcggggaggtcagtgc

SEQ ID NO: 51989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggggtttccgcacggtgagattctcgtcatc

SEQ ID NO: 51990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaaacggcctctcaggaaggtactagcg

SEQ ID NO: 51991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaaatagttcgagacgacgctcattgcg

SEQ ID NO: 51992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaaatgcctaacccggcaagccgatttc

SEQ ID NO: 51993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaacagttgataccgtcgggttctcgca

SEQ ID NO: 51994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaacgttacggtctaagcgggacggggg

SEQ ID NO: 51995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaactggccgcttggaggcagctcgtcg

SEQ ID NO: 51996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaagatggtcgtgtaaaggcattgacgt

SEQ ID NO: 51997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaataagcggaggcgctaggaaacacgc

SEQ ID NO: 51998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaatcggtattactttatgtaccacaca

SEQ ID NO: 51999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtacggccctaattgcgcgtgctgttccg

SEQ ID NO: 52000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtacggcttctaggacatttgaattacgt

SEQ ID NO: 52001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtacggtgtcgatctcactcggacggcgc

SEQ ID NO: 52002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtagacaagtacgggtctgttaagtcaaa

SEQ ID NO: 52003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtagactgaatgttgcccggctgtattcc

SEQ ID NO: 52004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtagagcgcgttcggtaggctgtggtcgt

SEQ ID NO: 52005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtagcagctctcatccgtccgcctcattg

SEQ ID NO: 52006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtagcgcggtgaatcaaatcgactggatc

SEQ ID NO: 52007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaggcatcagagtacacttgccttgttc

SEQ ID NO: 52008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaggccaggctagcgtgcggggaattac

SEQ ID NO: 52009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaggcgggctgtattccaggtgaggtcg

SEQ ID NO: 52010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtaggtcactgagggacatcaagtattgg

SEQ ID NO: 52011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtagttgttggtggagggctcggattacg

SEQ ID NO: 52012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtatacaatgccaagaagttttaaggtta

SEQ ID NO: 52013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtataggaccaggggttcgtgtcaagggg

SEQ ID NO: 52014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtatgctaaaatgccctataacacgggcc

SEQ ID NO: 52015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtatgtaatccgggctactacgtgacatt

SEQ ID NO: 52016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcaaccactcgaagtctccatcctgact

SEQ ID NO: 52017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcaagcacgaagaggtccatggaaaaga

SEQ ID NO: 52018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcaatccgagcaccacacaggttggccg

SEQ ID NO: 52019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcaatggtggcgacatgaaccgactttc

SEQ ID NO: 52020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcacatggtactgggggacggaaggcgc

SEQ ID NO: 52021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcagcagtcgcgattcttcacttcggcc

SEQ ID NO: 52022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtccacgcgttgggataggttacgttagt

SEQ ID NO: 52023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtccctcactgtaaacatatcatagacca

SEQ ID NO: 52024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtccgctcgatgtgacagttcgtatgttt

SEQ ID NO: 52025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcctcgtgcaacccaatggagaaaggtg

SEQ ID NO: 52026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcgacttagggcttattgtcatgtcctc

SEQ ID NO: 52027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcgagcggttaagcaatactcccttgct

SEQ ID NO: 52028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcggcattcttaaaggcgctcgttgtag

SEQ ID NO: 52029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcgggcgcccggtaacttgcaccttatt

SEQ ID NO: 52030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcgggcggcgatgatagttggttgcaac

SEQ ID NO: 52031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcgttgcaagatgattgaaatgtgcttt

SEQ ID NO: 52032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtctcatcccacatgtgcttggtggtata

SEQ ID NO: 52033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtctgggcgtagtctgccaagccttggtg

SEQ ID NO: 52034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtcttgggtgaattgtttgcgagtagggg

SEQ ID NO: 52035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgaagcaaagtatcgatgcctctcggtc

SEQ ID NO: 52036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgaaggaggcgagagcctcgggccaatg

SEQ ID NO: 52037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgaccggggggttgcgttaccgctagga

SEQ ID NO: 52038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgagcgggtaggtttctgttctggcggg

SEQ ID NO: 52039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgaggagcatccgtaccaacgctcggtg

SEQ ID NO: 52040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgaggcctatccgtgctctatcggctcc

SEQ ID NO: 52041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgagttcgcaaccatcacggattaattt

SEQ ID NO: 52042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcaaatgtgtcaaccgacctgccatgc

SEQ ID NO: 52043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcaacgtgggtcttcgcagcttcggga

SEQ ID NO: 52044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcaggtcttgaatcgtatccggttggc

SEQ ID NO: 52045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcatcgcctccaaatcccgagaatcaa

SEQ ID NO: 52046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgccgggtaatgggcttctcctaggcaa

SEQ ID NO: 52047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcctggatagtgcttgccgtaaggcta

SEQ ID NO: 52048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcgccgagaaatgactttgcgtggact

SEQ ID NO: 52049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcgctatcaggcattggagcttgaatt

SEQ ID NO: 52050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcggcgaacgatacgatcctgctggtt

SEQ ID NO: 52051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcggcttagttggcgtacacaccaggc

SEQ ID NO: 52052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcggtgaatgccagccgtgcgggatcc

SEQ ID NO: 52053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgcgtatggtaggtgccgatgcccagcc

SEQ ID NO: 52054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgctcgccaaggcaaacgcgtgggctgg

SEQ ID NO: 52055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgctgccaggctcgcgttcaaggcggcg

SEQ ID NO: 52056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtggaaaccaatcttaggttttatcggtc

SEQ ID NO: 52057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtggcaaccttcttcatcgttcgtcggac

SEQ ID NO: 52058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtggccgctagctcgtgattggccgtggc

SEQ ID NO: 52059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtggcgaagagagatacgtgagcgcatgg

SEQ ID NO: 52060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgggagcactctgatgtcatagcgccct

SEQ ID NO: 52061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgggataagcgtaagtttgttcagcgta

SEQ ID NO: 52062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgggcgccccgaggccgaaggatagcct

SEQ ID NO: 52063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgggtcgttcggtgtatggacatgggtg

SEQ ID NO: 52064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgtcatcctgatgtcggactgaatcggt

SEQ ID NO: 52065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgtgcaccggcgagcagctagctcttac

SEQ ID NO: 52066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgtgcgtgtggagctttctacctatgtc

SEQ ID NO: 52067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgttgcggcgcgaacgtcgagagatgta

SEQ ID NO: 52068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtgtttagccactcctccagcactttggg

SEQ ID NO: 52069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttaaagcaacagctgtatggtgtactta

SEQ ID NO: 52070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttaactgaggatacagttttggacatcg

SEQ ID NO: 52071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttaagcagcaccaggcggacttattctt

SEQ ID NO: 52072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttaatccgatatcgcaccgctgccggag

SEQ ID NO: 52073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttacccgtttagcatttcccgaccgcat

SEQ ID NO: 52074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttagaatgcgacagcgcgcaattttgcg

SEQ ID NO: 52075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttagagcattacgacttgtgcactagtg

SEQ ID NO: 52076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttaggttaatcgtagcgtcatgcccttt

SEQ ID NO: 52077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttatacccatgtcagagctggtgtccag

SEQ ID NO: 52078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttatggagtacctgcgccactttgacgt

SEQ ID NO: 52079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttcaagcagaacagtgtgcttgttgtgc

SEQ ID NO: 52080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttcaccagagggtctggacgcgggtagc

SEQ ID NO: 52081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttcacttctgttgctattcccgagcatg

SEQ ID NO: 52082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttcgaccgggcggcggtcgcatcggcac

SEQ ID NO: 52083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttctttcgccgtccacggtttactctgc

SEQ ID NO: 52084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttgcacgaataggatgcgtgtggtatgg

SEQ ID NO: 52085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttgccatagaacgagggacagaactatg

SEQ ID NO: 52086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttgcgtctggtgtgctgactgggtgatt

SEQ ID NO: 52087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggttgtcgtactagctggggggagggctcg

SEQ ID NO: 52088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggggtttgaactccgttgatagcgatggtgga

SEQ ID NO: 52089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaaaagctttgtacaacatcgctagtgca

SEQ ID NO: 52090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaaacgcgcgcggtatctgttctttatcg

SEQ ID NO: 52091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaaataccagagaggagtggtttagtggc

SEQ ID NO: 52092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaacacagaggatggaagtttccttgggg

SEQ ID NO: 52093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaacaccgcaaaggtacggtcatcgaatt

SEQ ID NO: 52094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaaccgtccactgtagcgctctttgtgcg

SEQ ID NO: 52095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaacgcgtaggctacccacggagagttcg

SEQ ID NO: 52096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagaagatatgggtggggactggagcac

SEQ ID NO: 52097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagacgatcggaacccaggatggttcgg

SEQ ID NO: 52098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagagttgacacaaggcataaaggtgct

SEQ ID NO: 52099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagcaacacgcgaatgatgtatgctatt

SEQ ID NO: 52100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagctggtcggtcgaagtgggcgagcta

SEQ ID NO: 52101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagcttgcggtgtggtcagtgttccgtg

SEQ ID NO: 52102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaaggggcacatgccagagccctcggtag

SEQ ID NO: 52103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagggggaggcggttacccggtgttaga

SEQ ID NO: 52104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaagtgtcagcacaagtaggcttgaacgc

SEQ ID NO: 52105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaataaaggaccaagctgtggaggacggc

SEQ ID NO: 52106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaatgaaccggtggtggtacacacatttg

SEQ ID NO: 52107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaatgttgtatgatcggtttggacgtact

SEQ ID NO: 52108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaattagcccaacgtacgtatcgtgaact

SEQ ID NO: 52109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacagttgaacggtgtccttgtgtggatt

SEQ ID NO: 52110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaccacgcacgcagcgatgtgaacatccg

SEQ ID NO: 52111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaccagtcgcgttctctcggcctgggtta

SEQ ID NO: 52112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacccggcggatataaggcctttggtctc

SEQ ID NO: 52113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacccttagaacatatctgactaacccgg

SEQ ID NO: 52114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaccggaaagacatctgagaacgaattgg

SEQ ID NO: 52115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgaccagatgcattacgacatgagggg

SEQ ID NO: 52116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgacgccattcgatgctcccggctaat

SEQ ID NO: 52117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgatcgatccacgtcagctttctgagt

SEQ ID NO: 52118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgcagtatgatcacgacacagatgagg

SEQ ID NO: 52119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgcctcagatcatggtacgcctttgta

SEQ ID NO: 52120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgcgcaccgttagaattcggaatccaa

SEQ ID NO: 52121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgcgcggtcacgatagagggtcttggg

SEQ ID NO: 52122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgctctccaggacgaatcagttcttta

SEQ ID NO: 52123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgcttaactacggccattttacgcggg

SEQ ID NO: 52124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacggcagccactgatgtcatggtcgggg

SEQ ID NO: 52125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgggcagtggtatgcctgctatgtggc

SEQ ID NO: 52126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtacgttattttaatgcagatttatgatag

SEQ ID NO: 52127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtactaatgtcggcatccgctagagtggct

SEQ ID NO: 52128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtactagttttcaacaacgtaatagtattt

SEQ ID NO: 52129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtactcttggactcgtcgtattgcatcggt

SEQ ID NO: 52130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagaagccgccatatcggtggttgtacgg

SEQ ID NO: 52131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagaagggaagccagatgactcccaagac

SEQ ID NO: 52132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagaatccgctcgtttgtagtcactctcc

SEQ ID NO: 52133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagattaatgcgcgaatctccattcccgg

SEQ ID NO: 52134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcagacgcacgtcttggggctacaccg

SEQ ID NO: 52135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcaggcgttgctgcacggcgtatggga

SEQ ID NO: 52136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcagtaggttggcgcgtcatcatgcgg

SEQ ID NO: 52137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagccggttgactgggccaccagtatgat

SEQ ID NO: 52138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcgcgtgttgagacacggtccaatacc

SEQ ID NO: 52139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcggtatctctttttcttgggctaagt

SEQ ID NO: 52140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcgttttagctccggtggtgccggtaa

SEQ ID NO: 52141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagctccgtatacagacacactgcggttc

SEQ ID NO: 52142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagcttcaccgtgccctgacatgatcggt

SEQ ID NO: 52143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggacctgaccgatgcgttagccggcgt

SEQ ID NO: 52144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggagctactgtcatcgtgcggcccggg

SEQ ID NO: 52145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggaggttcatcggagttactccccccg

SEQ ID NO: 52146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggcagggggggacgcacgatcacactg

SEQ ID NO: 52147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggcgtaaccgaatgatcctcgcagtcg

SEQ ID NO: 52148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggctattacaccgctcacggacggctg

SEQ ID NO: 52149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagggcacttccaagcagtggtagctcgc

SEQ ID NO: 52150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagggggtccgaaagcagtggcccggggt

SEQ ID NO: 52151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggtgttggaacggtcatggttgtgttt

SEQ ID NO: 52152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtaggttctactgcgtctgtcgggcgaatg

SEQ ID NO: 52153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagtccgaaagcgggacgaagcggggatg

SEQ ID NO: 52154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagtggcctggtatccttacgcgcaaagt

SEQ ID NO: 52155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagtggtggtcttgctaccaatggcctgc

SEQ ID NO: 52156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtagttgccctacagcgctttttctgtgtg

SEQ ID NO: 52157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatacacagtccgcagtccgtgcacaggg

SEQ ID NO: 52158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatatcggtcaacaaaccatgtacggtgg

SEQ ID NO: 52159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatcaagtctttcctgcgtcaggatagtg

SEQ ID NO: 52160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatccgggaggatcggtcagggcacgttt

SEQ ID NO: 52161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatccttgcgctgtagcggtgtggtactg

SEQ ID NO: 52162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatcgcatggtacgtgaaggcaacgaaag

SEQ ID NO: 52163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatcggcaaggagaagttgggagctcgtc

SEQ ID NO: 52164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatcgtcataagtcattgctttgtaaaga

SEQ ID NO: 52165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatctttaagctgtccctgtggcgcagtg

SEQ ID NO: 52166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatgatcgcgcatgatggcagttactgat

SEQ ID NO: 52167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatgatggacttttgtggtttcccccttc

SEQ ID NO: 52168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatgcaaaatggtaatcccgcacagttgt

SEQ ID NO: 52169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatgccggctcggattatggtggattaat

SEQ ID NO: 52170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtatggggtccgcacgcaaatttcagcata

SEQ ID NO: 52171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtattacgctggaagaggcgccttctcgtg

SEQ ID NO: 52172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtattatgctcatttatcccggccattatc

SEQ ID NO: 52173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtattggtccggataggggatgaacgcccg

SEQ ID NO: 52174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtattttgagctgcgtttgagttaggttgg

SEQ ID NO: 52175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaacacgctccgcagtctggatcgttcc

SEQ ID NO: 52176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaacgttttgctggcgcaacagatcggg

SEQ ID NO: 52177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaagataccttctaggtattatcagatg

SEQ ID NO: 52178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaagcaagagcccccagtctggtacacg

SEQ ID NO: 52179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaatgcacaatgttaatatgtgggcctg

SEQ ID NO: 52180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaatgcgaaatgcgtgcttaactatcca

SEQ ID NO: 52181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcacaagtccaggtgtgtgcccaggaacg

SEQ ID NO: 52182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcacaccgacgcctttttggtcattgggg

SEQ ID NO: 52183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcacacgcgtactaggagcccgtttccga

SEQ ID NO: 52184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaccgcacaggggatgaatgtttgatct

SEQ ID NO: 52185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaccgggcgtaatatctcgctgcacagg

SEQ ID NO: 52186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcacgggactcgttcagctggctggctct

SEQ ID NO: 52187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagaccagattagtcccggggtaaggta

SEQ ID NO: 52188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagccgcgctgcaatatcgtgggtttct

SEQ ID NO: 52189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagcttccgggggactagcttctcctgc

SEQ ID NO: 52190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcaggcggaacagtttgttgctcaggttg

SEQ ID NO: 52191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagggaactcccaatcatccgggtgagc

SEQ ID NO: 52192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagtcggtggtgcctacggagcccatgc

SEQ ID NO: 52193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagtgacgcccatcactatgaaggagcc

SEQ ID NO: 52194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcagtgtcgggccgcgcggtgtcttacat

SEQ ID NO: 52195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcatcgaagttggagtgcattttatgaaa

SEQ ID NO: 52196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcatgagacgctgagcccgctgtcattcg

SEQ ID NO: 52197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcatgcgggacacgggacactccctccga

SEQ ID NO: 52198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcatgctgagtactggtgtccaggcgtct

SEQ ID NO: 52199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccaccataagggcttttgtgtaatacca

SEQ ID NO: 52200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccacgccgcatcgctatcggcaactgct

SEQ ID NO: 52201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccacggcaggaagttgggcagcatctcc

SEQ ID NO: 52202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccattggttgtaggggggtgatgtagta

SEQ ID NO: 52203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcccgaatacagatagtgggcgtcacatg

SEQ ID NO: 52204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcccgcaggtccgagctattttggctggg

SEQ ID NO: 52205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcccgcgtcactctgctttcatgggcgta

SEQ ID NO: 52206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcccggatccttaacggttgctaagcccg

SEQ ID NO: 52207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcccgggggcggcgcttaagtatgttatg

SEQ ID NO: 52208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcccgtggtagactggattgtgaacgagt

SEQ ID NO: 52209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccgaggcaggtacgcgcatcctctgtac

SEQ ID NO: 52210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccgatctgtcgacacgtggcgcatcgtt

SEQ ID NO: 52211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccgattcatttggtctcagtctcgatcg

SEQ ID NO: 52212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccgcgccttagttcttcctctcggtcgg

SEQ ID NO: 52213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccgctgtgaaggaggcttaaagacgtag

SEQ ID NO: 52214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtccggatggggccaactgaacgcgtgggt

SEQ ID NO: 52215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcctgggaatcattcccgcggaacgtctc

SEQ ID NO: 52216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcctggtcatgctgtttaccagttaatcg

SEQ ID NO: 52217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcctggtcgctgatgcgcctactcagggt

SEQ ID NO: 52218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcctttattattctacgtccccttttggc

SEQ ID NO: 52219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgaagcttatatgaaaattggctcctgt

SEQ ID NO: 52220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgactcccgttttcacagtctgagtcgg

SEQ ID NO: 52221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgagcgtatagctaacctgtgacccgcg

SEQ ID NO: 52222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgagttaccggttccttagtagagtctt

SEQ ID NO: 52223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgatcctgggctttatcagcttatttgt

SEQ ID NO: 52224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgcaggttaacttagctactggccgctt

SEQ ID NO: 52225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgcagtggcgttgccggagcgggcggtt

SEQ ID NO: 52226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgctccagattagtgcgcgtccacatcc

SEQ ID NO: 52227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgctctacggacacccagatggactgcc

SEQ ID NO: 52228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggaacagcccttctgtgcgggtgaaag

SEQ ID NO: 52229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggaatagaagccgctgtgcctatgatg

SEQ ID NO: 52230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggaggcagctcgaaaatcgtggccaag

SEQ ID NO: 52231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggagtgtcacctgttgttcgagtaccg

SEQ ID NO: 52232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggcacatgtgtgctatggtagtggact

SEQ ID NO: 52233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggcggaaatgatcaggccctggtggtg

SEQ ID NO: 52234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgggaagattgccttcgacggtagtcct

SEQ ID NO: 52235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgggacctcatcgtggacggcgcaatgt

SEQ ID NO: 52236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgggcgccgtgagccatccaggcgtgtg

SEQ ID NO: 52237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggggattcattatgtggccccagggtt

SEQ ID NO: 52238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggggggctcgggaactggactgctctc

SEQ ID NO: 52239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcggtccgttggtgacaactttgcctctg

SEQ ID NO: 52240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgtcactactgccagactgctatgtgtg

SEQ ID NO: 52241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcgttccccgtgaatttgttgtaatcgat

SEQ ID NO: 52242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctactaggatcttccagacagcaagctg

SEQ ID NO: 52243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctacttcgggcagctcggaccaccctga

SEQ ID NO: 52244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctcaacaaagagcgtgacgatggctagt

SEQ ID NO: 52245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctcccgcattcgatcagaagagcctcgg

SEQ ID NO: 52246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctcccgtgtaagaccacgactcgtcatc

SEQ ID NO: 52247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctcgaccgcgagtctgtgccgagcccga

SEQ ID NO: 52248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctctttcgctcgcttcacgctttgtaca

SEQ ID NO: 52249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctgaacctattgtcgagttgtgttcagg

SEQ ID NO: 52250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctgagttcttcgtacctcggggttcgtt

SEQ ID NO: 52251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctggccggcgtcaacatgatgcctctgg

SEQ ID NO: 52252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctggtgtagcatagtctataaaccgtta

SEQ ID NO: 52253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtctgtggtccctgcgatgatagtgatcta

SEQ ID NO: 52254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcttattctgatcacccaggggccggctt

SEQ ID NO: 52255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcttgtctcatggatcgcgagggggcgcc

SEQ ID NO: 52256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtcttttccagcaccacgcgatgttacttt

SEQ ID NO: 52257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaaagcctagctagcacgcgttgcacta

SEQ ID NO: 52258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaaccaggcaactctgcccgactgcttg

SEQ ID NO: 52259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaaggtgatctatcgaaagagttttgga

SEQ ID NO: 52260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaagtaccgttcaggttaggatgctaac

SEQ ID NO: 52261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaatgctttcttagactataaaggcaga

SEQ ID NO: 52262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgacaaggcgaggtatggccaacactctg

SEQ ID NO: 52263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgacatggtggaagcgtgtattgggcttg

SEQ ID NO: 52264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaccacagtggtatgcacgccgttgatg

SEQ ID NO: 52265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaccattaggttcttacggcccgtttcc

SEQ ID NO: 52266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaccggatcttgtgacgcgacaatagac

SEQ ID NO: 52267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaccgggactcaaagggggtggaggttt

SEQ ID NO: 52268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgacgtcgatgcaatgctcccaaaaatct

SEQ ID NO: 52269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgactctatagagacgcggacgcttattt

SEQ ID NO: 52270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgactgttcatctgcgcatctaagcagac

SEQ ID NO: 52271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgacttcacgaggacacccgtcggcagta

SEQ ID NO: 52272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgagaaactgaagacctgtctactcgctg

SEQ ID NO: 52273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgagagattggctggcggatggttttttt

SEQ ID NO: 52274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgagagcatcacacgtccacacgtggcac

SEQ ID NO: 52275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgaggagggggtttcgggtctgttgcacg

SEQ ID NO: 52276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgagtacgagggtgttaccgttgatccta

SEQ ID NO: 52277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgagtttattcatcgtttcccaaactccg

SEQ ID NO: 52278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgatataccgctagacggttataatcgta

SEQ ID NO: 52279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgatggcgagtggatggaccaggccagac

SEQ ID NO: 52280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgatttagtcgtgccgcttcgttcgttga

SEQ ID NO: 52281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcaaaggctgtcatagaagcggcccacg

SEQ ID NO: 52282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcaccttctaggcggaacagatcgttag

SEQ ID NO: 52283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcaggaccggatgggtagaggacgatct

SEQ ID NO: 52284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcaggagaggcttgcttaaacgctcatc

SEQ ID NO: 52285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcagggtgctttgggctgtaatgttccg

SEQ ID NO: 52286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcaggtcatgctactgtacgaagtccat

SEQ ID NO: 52287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcagtcatgttaagccaagattcgattg

SEQ ID NO: 52288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcagtttcgactcataccagcgctgcga

SEQ ID NO: 52289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcatggctacgtgtatccgcgaggcacg

SEQ ID NO: 52290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcattcatctcggtgcagtagaatcgcg

SEQ ID NO: 52291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgccaacatgtggtctcgatacatcgcgc

SEQ ID NO: 52292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgccaattcctctgttaatgtggtccggg

SEQ ID NO: 52293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgccgatccatttcagggcacggaaatat

SEQ ID NO: 52294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgccggagaacgtcacaataattgcactc

SEQ ID NO: 52295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgccgtcgaattgtggaaccgctgggctt

SEQ ID NO: 52296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgccgtcgctgatcttggacgcttcttct

SEQ ID NO: 52297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcctattgcgccgggacaggctagccgt

SEQ ID NO: 52298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcctgttaaatggtggtcatctcccggt

SEQ ID NO: 52299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgaatacatgaaggcatcgttaccgtg

SEQ ID NO: 52300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgaggaggctggtccaacaactgacct

SEQ ID NO: 52301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgaggcgtgcacttagcgcggaggtgg

SEQ ID NO: 52302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgagtgcgattgggtcacattccggtt

SEQ ID NO: 52303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgcagacggggtgcggtcgtaggcttc

SEQ ID NO: 52304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgcataggcatctttatttcgcggcaa

SEQ ID NO: 52305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgcctctctcttgggtggaccaactcg

SEQ ID NO: 52306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcggccttgaacgtcacggaatgttact

SEQ ID NO: 52307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcggtgtcggttaagccagttttgccgc

SEQ ID NO: 52308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgcgttagccttggatcggaatacccggg

SEQ ID NO: 52309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctaacaaagacgtccggccatatggca

SEQ ID NO: 52310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctaaccaggcccactcccggagttgtt

SEQ ID NO: 52311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctaccggtaatcgtacagctgaggtgt

SEQ ID NO: 52312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctactccagttacttctctcgctgcac

SEQ ID NO: 52313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctcagggacggttgtgtcctgtcggcg

SEQ ID NO: 52314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctcgcgagagtcgcaaagtccactcgt

SEQ ID NO: 52315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctctggcctcgggttacgtcactcatg

SEQ ID NO: 52316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctgagcgataactgggcggtcaggctc

SEQ ID NO: 52317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctgatggtgaacggtagatactcgacg

SEQ ID NO: 52318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctgcctacagttctggaaaaggggtgc

SEQ ID NO: 52319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctgctctgtatgaagcctacaactgag

SEQ ID NO: 52320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctggccgaaaggtccttcgctgttagc

SEQ ID NO: 52321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctgggcatactggtggagccgatcatt

SEQ ID NO: 52322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctgttaggtggatattcgaatcctaac

SEQ ID NO: 52323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgctttcttttgtcatgcgggcacacggt

SEQ ID NO: 52324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggaagacgaggccttggggagtggtgac

SEQ ID NO: 52325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggaccaacctacggtattgcttaagatc

SEQ ID NO: 52326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggagaagcgtgtttcttgggcgggccgg

SEQ ID NO: 52327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggaggcactcctaccacaaggggcggct

SEQ ID NO: 52328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggagtgagactcacgcgattgtacagtg

SEQ ID NO: 52329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggataggacttgcttcccattaggtgac

SEQ ID NO: 52330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggatgcgtcctgcctatcggttatctta

SEQ ID NO: 52331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggatgttcgcggccgtcccttctggtct

SEQ ID NO: 52332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcactaactcttgcgcatatgtgtgaa

SEQ ID NO: 52333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcatcgagaggcttactggggggccgc

SEQ ID NO: 52334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcatggtgttgtggagcgatcgattgt

SEQ ID NO: 52335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcatgtacaagttaggagagcgatcca

SEQ ID NO: 52336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggccgatgcatagtcgacggagcggtca

SEQ ID NO: 52337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcgagcagatgtaagttggtgacggtt

SEQ ID NO: 52338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcgatagcagccgggaaacagtatgca

SEQ ID NO: 52339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcgcctgcacttagtacggtgatctct

SEQ ID NO: 52340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcgctcgcgttcgcgctagctagtaga

SEQ ID NO: 52341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggcggtcggcagtgtttatcccttttcc

SEQ ID NO: 52342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggctaggaaggccgggtgccacggtttg

SEQ ID NO: 52343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggctccttcgttacctaatcaagcttag

SEQ ID NO: 52344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggctgggaggtgatcccggtaatttgtt

SEQ ID NO: 52345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggctttattcgttcccactcgtcacagt

SEQ ID NO: 52346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggaagacacaacgtttggggtggatcg

SEQ ID NO: 52347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggaagcccgtgcgacctcctagccaga

SEQ ID NO: 52348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggacgtgcttaagtgaccgcgcgagtc

SEQ ID NO: 52349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggcaggggtcgtgtccggtaccagctc

SEQ ID NO: 52350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggcgagatattcacgctaggccaggac

SEQ ID NO: 52351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggggagcagtacgtctgctgttgatggg

SEQ ID NO: 52352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggggcggacattcggataatgtagtatc

SEQ ID NO: 52353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggggaggtatgtaaggttggggtagtt

SEQ ID NO: 52354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggggcgataacgccgtatgggctcacg

SEQ ID NO: 52355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggggttcaaagacgctcagaggccgcac

SEQ ID NO: 52356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggtgacctgaacgtacagcgggtacca

SEQ ID NO: 52357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgggtgagtacggcgaaatgcgggcgtgg

SEQ ID NO: 52358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtaagatactgagccaaattcgtgctt

SEQ ID NO: 52359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtataagtgcggctggacgctgccacg

SEQ ID NO: 52360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtccgagactgggatcaatgcacacgg

SEQ ID NO: 52361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtctgtgctatgctgtgcctcttgcct

SEQ ID NO: 52362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtctttagctggacatcctttgcttac

SEQ ID NO: 52363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtgatgcgcatttatcgtgctccggag

SEQ ID NO: 52364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtgatttgctgaagagtcctggctttc

SEQ ID NO: 52365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtggattaaggggggtattcctcacaa

SEQ ID NO: 52366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtggcatgtatttatatccgccctttt

SEQ ID NO: 52367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtggctgaccgccgttaattaacagtg

SEQ ID NO: 52368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtgggcttctgcgaatgtgctggcggc

SEQ ID NO: 52369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtggtgtgggtgaggtgcaaagagtgcatt

SEQ ID NO: 52370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtaatcattccaaggccttgtatcgggg

SEQ ID NO: 52371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtacgcggttactgtcacgttttcccca

SEQ ID NO: 52372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtagtagcgcaactattggttcgcctcg

SEQ ID NO: 52373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtatcgtgcccggagtgtaccagctttt

SEQ ID NO: 52374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtcaattacttctgttactgatggcagt

SEQ ID NO: 52375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtccgggcacagaaatggaccgtgggcc

SEQ ID NO: 52376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtcgattgggtccattggcgtgtcgtcg

SEQ ID NO: 52377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtcggcaaggagttgttcttggctggcc

SEQ ID NO: 52378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtcggcgcgatctcccgggggggctagg

SEQ ID NO: 52379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtctcggattggatgtccaacgtcaacg

SEQ ID NO: 52380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgaacgcgtcacctgtatcgcagcgta

SEQ ID NO: 52381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgaagttgtgttccctctggagttagg

SEQ ID NO: 52382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgagggatggagggttctgcacttcaa

SEQ ID NO: 52383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgcaaagggcccaactcaacgggacca

SEQ ID NO: 52384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgctaccctggtaaacagtacgcagga

SEQ ID NO: 52385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgggcagcagtgtgtaccgtttgtagg

SEQ ID NO: 52386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtgtatcgtctgtgcagcgtcctgtgat

SEQ ID NO: 52387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttagctccgacctcactggccttcagc

SEQ ID NO: 52388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttagggccagtaacaggtatggattga

SEQ ID NO: 52389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttcaggccagctgcacgtgccatgccg

SEQ ID NO: 52390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttcaggctatctagcacttgaccggtc

SEQ ID NO: 52391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttccgagtgcttcggcgtcatatccgc

SEQ ID NO: 52392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttctagcatcgcagggagtactaagtg

SEQ ID NO: 52393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgttggcgtgctatacgagacgttatgga

SEQ ID NO: 52394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtgtttatcgagtagtaatccgtagaagta

SEQ ID NO: 52395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttaaaatctcactgccaaactctaataac

SEQ ID NO: 52396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttaaggcttgggaggacatacacgccttc

SEQ ID NO: 52397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttaaggggctagattccgcagggtggtcc

SEQ ID NO: 52398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttaatacatcagccagcccattcggcgtg

SEQ ID NO: 52399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttaatgggcggcgctctgattacacgtcg

SEQ ID NO: 52400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttacccaacaggagtgctcgcagatcgct

SEQ ID NO: 52401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttaccgtcggactagccgtgatttcgact

SEQ ID NO: 52402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttacctttcggataatggctatggatgat

SEQ ID NO: 52403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttacgactgcgatcgtcattccgcgggtt

SEQ ID NO: 52404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttacgttcagagtaacgaatcgtggtttg

SEQ ID NO: 52405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttactacgggtcgagggggaggccgctgt

SEQ ID NO: 52406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttactcgcgcccactcctagcaatgccga

SEQ ID NO: 52407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttactgagtccatgtagggcgctggccca

SEQ ID NO: 52408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttactgcaaggaccgtacattttgcctgt

SEQ ID NO: 52409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttagaacgaacctttgttttacagtggag

SEQ ID NO: 52410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttagagcagacaccaccatcaatcccttc

SEQ ID NO: 52411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttagagcttagcttcgtcaggtagtataa

SEQ ID NO: 52412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttagaggacttgcggacccaggcgtactt

SEQ ID NO: 52413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttagcagcacagatcgcttgtcttttctt

SEQ ID NO: 52414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttagcgcggacaagaatagcacatgggcc

SEQ ID NO: 52415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttataggtttacgcgactgacggccgcgg

SEQ ID NO: 52416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcaaatcattctagctgccgagtggcgc

SEQ ID NO: 52417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcaaggcaccatggcccttgttccctgg

SEQ ID NO: 52418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcaccaggcgatcggagtagatggccga

SEQ ID NO: 52419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcacgactatgcaagcgaagtaagttcg

SEQ ID NO: 52420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcacgccttgaatccagctgcggtgggc

SEQ ID NO: 52421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttccagctccttttacgtctatagacttt

SEQ ID NO: 52422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttccatagcagcaccggtaatcagtcatg

SEQ ID NO: 52423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttccatgacccgataagaatgctgcaaat

SEQ ID NO: 52424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcccagataccctacgattcggcgcacc

SEQ ID NO: 52425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttccctgacgccggtctccgtctccattg

SEQ ID NO: 52426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttccgcacggagtgtggcatgctgccttg

SEQ ID NO: 52427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcggaagtacactgagcgaggtggttta

SEQ ID NO: 52428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcggccttgattgtcagtcttttgctac

SEQ ID NO: 52429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcggcttaggtattctgcttcattgtgt

SEQ ID NO: 52430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcgggggtcgatgccttatctgttcgta

SEQ ID NO: 52431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttctcaggctaggcgggtgttggtatcat

SEQ ID NO: 52432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttctctggcatcccccttcgatttgacca

SEQ ID NO: 52433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttctgtgcaacgaccatgactgtttcatg

SEQ ID NO: 52434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttctgttgagggagcttttgtgtgcgcat

SEQ ID NO: 52435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcttaggtcatcccgtcaacggtgcatg

SEQ ID NO: 52436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttcttagttgccaaatttatcaacagtgc

SEQ ID NO: 52437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttctttgtggctttttaaaacgtgctcgt

SEQ ID NO: 52438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgcatacacacgtatgatcaccacactc

SEQ ID NO: 52439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgccagcgatgcgcagaatagggttggg

SEQ ID NO: 52440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgccctgaaacgttaagtatcttgtcgg

SEQ ID NO: 52441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgcggagttagtgcttctggatacgcgc

SEQ ID NO: 52442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgctagtagttgcaggccagcttggtac

SEQ ID NO: 52443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgctccctgtcacggtgttgcaagcaac

SEQ ID NO: 52444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggaaggcctgcgggtggctaagggttc

SEQ ID NO: 52445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggaaggtttaggcagccattgcgagcg

SEQ ID NO: 52446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggccagtggcggagagggctggagcct

SEQ ID NO: 52447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggcgggcgggattggtaagaagctcct

SEQ ID NO: 52448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggcgtctaggaggttggcgcattgatg

SEQ ID NO: 52449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggggtgtttgcccttttattgttgccg

SEQ ID NO: 52450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgggtgccaggtggtcaggcgtgttctg

SEQ ID NO: 52451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggtccatcgtgtaaatccgcggtcgga

SEQ ID NO: 52452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggtgaaacccgttattaccagttgttg

SEQ ID NO: 52453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggtgacttccggaaatgtgcgagcgcg

SEQ ID NO: 52454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggttaaggacttgaacggggatctgta

SEQ ID NO: 52455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttggttttacggcgttgttcgcatgatga

SEQ ID NO: 52456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtaatcgggtttggcgttaatgccttg

SEQ ID NO: 52457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtagcagcacccccgggacaccgcgac

SEQ ID NO: 52458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtagtactcaccgtgggttcgatacct

SEQ ID NO: 52459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtcaggggatggcgcaccttccgatcg

SEQ ID NO: 52460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtcgataagagggtgcgggcggtaacc

SEQ ID NO: 52461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtgcattcagtccaagggcccttacac

SEQ ID NO: 52462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgtgttactggtacccggacaacgggct

SEQ ID NO: 52463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttgttgagcctgaccgtctgctcctgggc

SEQ ID NO: 52464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttaagacagtggcggcacgcctaacaaa

SEQ ID NO: 52465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttaatactgcaatgtgttataaaggatc

SEQ ID NO: 52466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttcggacacgttctactttatcacatgg

SEQ ID NO: 52467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttctcggctgcatacgactcctgtgttt

SEQ ID NO: 52468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttgacgggtaactccaggaatgtgggaa

SEQ ID NO: 52469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttgactgcgaagagggcttcaatcccta

SEQ ID NO: 52470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttgccatcggcgacctcgcttgtcgcac

SEQ ID NO: 52471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttgtgcacggtgcctttgttattttcgc

SEQ ID NO: 52472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttttacttgcggtcctctcatggtcgtag

SEQ ID NO: 52473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggttttctggttcggggcgcacgttttggtc

SEQ ID NO: 52474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttttagacggttaccggccgggtgctct

SEQ ID NO: 52475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttttcgctcggagccaaaagataaatct

SEQ ID NO: 52476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
gggtttttctaagaactgggttgtgtcatcgg

SEQ ID NO: 52477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaactggggacctcgtgcaggtattagc

SEQ ID NO: 52478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaactgggtggatgcgagtggaatgacg

SEQ ID NO: 52479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaagagcgactctacgctagggagttct

SEQ ID NO: 52480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaagcgcggatcgcacgatctacggggt

SEQ ID NO: 52481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaagggttggatttagtcgatcccggtt

SEQ ID NO: 52482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaagttcgacgtgccggggctccattca

SEQ ID NO: 52483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaacaccgacgatcgtgaggccataggat

SEQ ID NO: 52484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaactggaaccagcgcgcgtgcctcgtac

SEQ ID NO: 52485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaagagtctagatcggggagttgtgcact

SEQ ID NO: 52486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaagcgaaattgaacatcttattcacgtc

SEQ ID NO: 52487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaaggatgtagattcaggcgtgatatcgt

SEQ ID NO: 52488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaagtcatgtcgggatacaggaggagggt

SEQ ID NO: 52489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaatcggatcaacatcggggtcattaaaa

SEQ ID NO: 52490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaatgaacaggtgattacatgcgggcgcc

SEQ ID NO: 52491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaatgtaatgttcaaagcaataatgggag

SEQ ID NO: 52492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacaaggccgcgcgatgtttgcggtggag

SEQ ID NO: 52493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacaagtttcccgtttgcgatttgtgtca

SEQ ID NO: 52494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacacgatattcacgaggcatgcaatcca

SEQ ID NO: 52495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacattacccatgggacgtgaaaaatagg

SEQ ID NO: 52496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacccgccaaaccttgctcttgccgtccg

SEQ ID NO: 52497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaccgcatttgtgtccggttgttgtactc

SEQ ID NO: 52498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaccgtgtcattcaggcctagcagtccct

SEQ ID NO: 52499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacctgcaatggatgatgatcatggccgg

SEQ ID NO: 52500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaccttcgggggaagggtgtgtcattctt

SEQ ID NO: 52501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacgatcgcgatacaaactcgtctttctc

SEQ ID NO: 52502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacgatgagagcgattgcctgaatgtttg

SEQ ID NO: 52503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacgcgttctcctcatccaggcattttgc

SEQ ID NO: 52504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacggaggaccgaacgaattaacccgtgc

SEQ ID NO: 52505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacggataaagttttgtttgctgttggcg

SEQ ID NO: 52506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacgggtacgctctgttgtttcactctct

SEQ ID NO: 52507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaacggtgttgtgcgttggagttcaaagga

SEQ ID NO: 52508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaactccatgatccattgcgttcgtgggtg

SEQ ID NO: 52509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagacatagaattcggtttagagctgtcg

SEQ ID NO: 52510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagactgcgcgtcccagctgtcgtacgaa

SEQ ID NO: 52511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagaggatcctgtccacgatatttccatg

SEQ ID NO: 52512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagaggtttccgaattagacccggcattc

SEQ ID NO: 52513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagagtacatgggaccgttggagggggga

SEQ ID NO: 52514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagcaggaccacacagcacgtaaagcgtt

SEQ ID NO: 52515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagcatccgcggacacgtgcccatggttc

SEQ ID NO: 52516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagcgaagtttgtcaaacgggtcattaac

SEQ ID NO: 52517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagcgtgcctaggaaaagaggtgggtttg

SEQ ID NO: 52518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagctaagtatcctactagcgtgattcgg

SEQ ID NO: 52519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagctcctgagattcatatacgtcgttgt

SEQ ID NO: 52520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagctgtggcctccgtccgttggggacga

SEQ ID NO: 52521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggaagtagtgaatctgtcccacatgaa

SEQ ID NO: 52522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggagatcatcgcacacttttcatcccg

SEQ ID NO: 52523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggccatctccagaacaagtagtagcgg

SEQ ID NO: 52524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggctgtcacttacaaatcaatcctgga

SEQ ID NO: 52525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagggcctgtcgagaagtggcaatgtagt

SEQ ID NO: 52526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggggatcttggggtagcgtcacacgtc

SEQ ID NO: 52527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggtgcacagtgctttagccggaacccc

SEQ ID NO: 52528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaaggtggtcacggagtgaggcgtctgcgg

SEQ ID NO: 52529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagtaaatctcttgatctaattatcccaa

SEQ ID NO: 52530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagtacacatttggcgggtggtattggac

SEQ ID NO: 52531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagtagacattttagcggggactggggta

SEQ ID NO: 52532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagtgaacgcgagtcgcggggcggctgtg

SEQ ID NO: 52533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagtgttgagtactcttttagtgctttgt

SEQ ID NO: 52534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaagtttgttttctagtgcgatcattctcc

SEQ ID NO: 52535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaataaggcgagtcgctgctgtcttgtgtc

SEQ ID NO: 52536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatagtagatgaattagtctggatctcat

SEQ ID NO: 52537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatagtccttgttcggggggtttaacgta

SEQ ID NO: 52538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatagtggttcatcgtcaatggggcgttt

SEQ ID NO: 52539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatcaccaggcacgagtgaataaacccgc

SEQ ID NO: 52540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatcattactggttattcgcctcacctcg

SEQ ID NO: 52541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatcctgatggtctatgtgtgatggagga

SEQ ID NO: 52542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatcgctccaggcgccgttcgttggcata

SEQ ID NO: 52543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatggagagcatctctttcccggtaactt

SEQ ID NO: 52544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaatggtcatgacgacattacgaagtcatg

SEQ ID NO: 52545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaattcttcctgtgatctatcgggaagggg

SEQ ID NO: 52546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaattctttgtcaaccaccgcatcaaggag

SEQ ID NO: 52547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaaacagcctatcttgccatatcgatgt

SEQ ID NO: 52548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaaagtggttcccaagacgatggagtga

SEQ ID NO: 52549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaacactgggcatagcttactggcagtg

SEQ ID NO: 52550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaacgtgcacttgtgcgaagaggtaccg

SEQ ID NO: 52551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaattattgaaaacgtgcgcaagtatca

SEQ ID NO: 52552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacacaaaccgcgttatatcaaatattgaa

SEQ ID NO: 52553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaccgccgtccatcacgatcacgatggg

SEQ ID NO: 52554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacacggaagtagcatccccggccctggta

SEQ ID NO: 52555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacacggctcgagcttattgtctgggtcgt

SEQ ID NO: 52556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacactgcctctacaggactcatagccggc

SEQ ID NO: 52557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacacttcgatattgatgctcctggcgcga

SEQ ID NO: 52558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacagatcaagggggcgctatggcttgtcc

SEQ ID NO: 52559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacagctcgctcatatgggggttaggggac

SEQ ID NO: 52560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacagctgaaggtcacgtactctgaaccgg

SEQ ID NO: 52561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacaggcgctttacaagtacgccggtttgc

SEQ ID NO: 52562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatagtggttcgtttgcggctaaatatc

SEQ ID NO: 52563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatatactgcttgctcacacgtcaagag

SEQ ID NO: 52564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatcaaacccactattcagtggcacata

SEQ ID NO: 52565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatcgaaagctgcatggtatgccggttt

SEQ ID NO: 52566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatcgagtatacgatgataaggcctaaa

SEQ ID NO: 52567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatgatgaccacacgcgttttagacccg

SEQ ID NO: 52568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacattcaagtacttttgtcttaacgttgg

SEQ ID NO: 52569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacatttacgcgattagcggtgtctttaac

SEQ ID NO: 52570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccacaacgctatgggcccaattcgtgca

SEQ ID NO: 52571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccacatggtaaggtcgcgttcttccggt

SEQ ID NO: 52572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccacattggcctttgcaaactttacacc

SEQ ID NO: 52573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccagacggcatattctcgtctgttagtt

SEQ ID NO: 52574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccaggataataatgtactatctgttttc

SEQ ID NO: 52575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccagggcgttctccgcgacttgtaattg

SEQ ID NO: 52576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccagttatgaaaggattttgttggaggc

SEQ ID NO: 52577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccagttccgaggacagttctccgtgatg

SEQ ID NO: 52578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacccggaagggttagtgtgcttatgagcg

SEQ ID NO: 52579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacccggctctaattcgtccgctgtaaatg

SEQ ID NO: 52580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccctacctgatgatatgtctactttgct

SEQ ID NO: 52581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccctttggcctttccacagcgctttcta

SEQ ID NO: 52582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccgcgtgaccgtaccgcagtcaaagggg

SEQ ID NO: 52583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccgctctaacctcttaaaatgggcggcg

SEQ ID NO: 52584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccggccgtaacacagctaccatggtggg

SEQ ID NO: 52585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaccgtagtttacaatcgtgtattcccgta

SEQ ID NO: 52586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacctcaggccgcgacgccgcttgcatcgc

SEQ ID NO: 52587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgaagctcatcttctccgcgggtgggga

SEQ ID NO: 52588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgacggagaagtcccgtatgaggatcgt

SEQ ID NO: 52589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgatggacgtgcttactaagcgaggcaa

SEQ ID NO: 52590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgcaatatttagctctttcgcttagtgc

SEQ ID NO: 52591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgcagcatggcatgcgatcgaatattgg

SEQ ID NO: 52592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgccgttctccccgtctgcgggtggctg

SEQ ID NO: 52593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgctcgtccatgtggcttttttagaccg

SEQ ID NO: 52594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgctgagagtctaggcagtacagttttg

SEQ ID NO: 52595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgcttcttagctcacaataagcacacct

SEQ ID NO: 52596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacggatctcaacgttttcacgaggacggg

SEQ ID NO: 52597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacggcgggcttttcgcggcacatttcgtc

SEQ ID NO: 52598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgggcggctgatgcgtgttacatttgtc

SEQ ID NO: 52599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacggggggcgtggacaggtgtatggctgg

SEQ ID NO: 52600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacggttgagagttcgcgaatctgttcgat

SEQ ID NO: 52601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgtattcgccgtgtttttgtattgcaac

SEQ ID NO: 52602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgtcggcgtccgcatcgagatagtcgct

SEQ ID NO: 52603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgtgacgttcaactgtttccgtctccgg

SEQ ID NO: 52604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacgtggcgttaacgaacgacttgcatctt

SEQ ID NO: 52605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactaaatcaggtccaactaactcttttct

SEQ ID NO: 52606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactaacacaactccaatcatattattgtg

SEQ ID NO: 52607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactaccacatttcggtacagttcgatcat

SEQ ID NO: 52608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcagcccacacactgcaacctgcttga

SEQ ID NO: 52609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcgaccaatggacaccgtccgacaagt

SEQ ID NO: 52610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcgaccggcacgcttcagcatatggta

SEQ ID NO: 52611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcgagcagatcgggttagtatgggtta

SEQ ID NO: 52612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcgataggtgttgcacgcgaatcgttt

SEQ ID NO: 52613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcgccttgatgagctactttcgcctgc

SEQ ID NO: 52614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactcggggtgtttactgcctttgaacctg

SEQ ID NO: 52615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactgagctcacgttctgtcccgtgggcgc

SEQ ID NO: 52616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactgcttaacctcccgagtggcccgcttt

SEQ ID NO: 52617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtactgtgtgatgtcccgcaacacagcattc

SEQ ID NO: 52618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacttaacggctattgaacactagttactt

SEQ ID NO: 52619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacttcacaccgaggcttaccatttgtctc

SEQ ID NO: 52620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacttggcgttctttctttaaaacagtctg

SEQ ID NO: 52621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtacttggtttgtgttatgctaatattaaca

SEQ ID NO: 52622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagaaacgaccgtacacaggaacaatcggc

SEQ ID NO: 52623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagaccatgcgggtcacctagctttagagt

SEQ ID NO: 52624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagacgggttaaggagaaatcagaggccgc

SEQ ID NO: 52625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagacgttgatcacaaagtgtcgaatgatt

SEQ ID NO: 52626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagactgcgcgccttgcgttgggtccgggc

SEQ ID NO: 52627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagagacatcattattctgccgtaaattct

SEQ ID NO: 52628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagagcaagagtttgccccattgagacacg

SEQ ID NO: 52629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagaggcgggatcagcggacgtgcagccat

SEQ ID NO: 52630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagatggtggtgcgcgagtgctgtggatat

SEQ ID NO: 52631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagattcagttgccgtgccctgcgacactt

SEQ ID NO: 52632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcaatgcgaatgtccaagacagtattgt

SEQ ID NO: 52633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcacgtcatgcttcgtgtctgcattact

SEQ ID NO: 52634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcagagagcggacatgtgggcaacctcc

SEQ ID NO: 52635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcataaacgaatttctatggaaggagtt

SEQ ID NO: 52636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcatctcggcattgctgaaagaccaagg

SEQ ID NO: 52637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcattgagaaagatccagcggcctaggg

SEQ ID NO: 52638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagccaacacactcagggattctggtctgc

SEQ ID NO: 52639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagccaatccgcgggcgatcccacatgggt

SEQ ID NO: 52640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagccacatctttatgtgtaggttcagggt

SEQ ID NO: 52641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagccgcagagacatgtgtcgcttggaagg

SEQ ID NO: 52642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagccgctgaatcaaacttaagcacgccgg

SEQ ID NO: 52643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcctggtgcgaagggttctaagttgcca

SEQ ID NO: 52644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcgatcacgatagttatttggttgatgg

SEQ ID NO: 52645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcgcgtccgagctggttttgtggtgccg

SEQ ID NO: 52646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcggacaaatcgttgagctacgagatga

SEQ ID NO: 52647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcggcgatgttttattaagagcgttgtc

SEQ ID NO: 52648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcggcgttaatgacggatctgtttgcgc

SEQ ID NO: 52649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcgggggtgattcgaattccatcgcctg

SEQ ID NO: 52650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcggtacataggacctgtatccaaagaa

SEQ ID NO: 52651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcggtagctagtggggatcggagtgttg

SEQ ID NO: 52652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcggttcaccatcatgcttacgttcctg

SEQ ID NO: 52653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcgttacttgtagtgtcttgcgttttgg

SEQ ID NO: 52654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagcgtttcgttcgtccagcacacaagcgc

SEQ ID NO: 52655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagctcgtctgtatgacatgcgtcatggat

SEQ ID NO: 52656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggacaggattgtttcacgaagtggggtg

SEQ ID NO: 52657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggagactcgcgataggacctggacgcgc

SEQ ID NO: 52658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggagcagcagcctcccgtgacgatgtgc

SEQ ID NO: 52659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggagttgccgacttccatcataagggaa

SEQ ID NO: 52660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggcagtggaccgaactcggatagcgtag

SEQ ID NO: 52661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggcatcggcccaaaagcaagtcctcttc

SEQ ID NO: 52662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggccctgtgaccgtgggctaaatcacgg

SEQ ID NO: 52663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggccgtatgttaacagcatcacgcggtc

SEQ ID NO: 52664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggctctgctcgttacaattacccggatt

SEQ ID NO: 52665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggctttagttgtttagagtgacgcctgt

SEQ ID NO: 52666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagggaaccgtccgagggaccacgttttag

SEQ ID NO: 52667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagggaggtaggtggcactggacttcgtgg

SEQ ID NO: 52668 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagggcggcgaggtaaaatcgtgttctcgg

SEQ ID NO: 52669 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagggctatcacccagtaggttaggccgag

SEQ ID NO: 52670 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggggagacacccgttgtcctcgatgagc

SEQ ID NO: 52671 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggggcctcagcgaccaggggggtcgggg

SEQ ID NO: 52672 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggtcagcgaacgacctagaaccagggag

SEQ ID NO: 52673 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggtcgggcatcgcgtgcacagctgtaga

SEQ ID NO: 52674 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggtctaggctttttcggtggtggactag

SEQ ID NO: 52675 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtaggttgcttgcgcgttagttgagcgttat

SEQ ID NO: 52676 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtacaatgctagcgactcaggggtttat

SEQ ID NO: 52677 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtatcctggttatagtggcggcgacggg

SEQ ID NO: 52678 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtattgatagagtgcccatttgccaaat

SEQ ID NO: 52679 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtattgctcccgtcaatctgctactgtt

SEQ ID NO: 52680 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtgacgctaagtcgatcgggaagaccta

SEQ ID NO: 52681 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtgagagcctaagcgtcaacgagtctgg

SEQ ID NO: 52682 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtgcaagacgttccgacatcgcgtacct

SEQ ID NO: 52683 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtgcctgattgattctaagacactcgcc

SEQ ID NO: 52684 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtggtatgtgtcccagttctgtggactt

SEQ ID NO: 52685 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtggttagtctcgccaccgcgctgcctt

SEQ ID NO: 52686 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtggttggctgtttgtttgggtctagct

SEQ ID NO: 52687 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtgtgatatagtccagaatctcctcacg

SEQ ID NO: 52688 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtgttactcttgtgctttgtggcacggt

SEQ ID NO: 52689 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagttaggtgcgacaggaggaattagcagt

SEQ ID NO: 52690 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagttgcaacttgtctagtcacgatcgtga

SEQ ID NO: 52691 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagttgcccggtaagcgtaccactcgtcca

SEQ ID NO: 52692 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtttaccatgagtgaagtttacgggtcg

SEQ ID NO: 52693 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtagtttcggatttgcacctttgtgttcgtg

SEQ ID NO: 52694 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtataacggggcgctttgagtagtttcgccc

SEQ ID NO: 52695 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtataatggtaatccaggttgtgctccgtgc

SEQ ID NO: 52696 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatacacaccggtactgtaggcagccaggg

SEQ ID NO: 52697 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatacggtcatgcgacgtcgtgcacctcct

SEQ ID NO: 52698 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatactaacacgtacaagcacgtcgagctg

SEQ ID NO: 52699 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatactcccgcttggcaaagtcgtcggacc

SEQ ID NO: 52700 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatagctatcgcacgacgttcggccgcgcg

SEQ ID NO: 52701 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatataagaaaacgagacggaccgcgcacg

SEQ ID NO: 52702 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcaaagaacaacgccatgcctcacctgg

SEQ ID NO: 52703 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcctatcgtttttgggtctacgggttgg

SEQ ID NO: 52704 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcctttacgatgcaaggcaagggactat

SEQ ID NO: 52705 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcgatctgcaagacaacttacggacggg

SEQ ID NO: 52706 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcggagggcttggtgccgtcgtgtggcg

SEQ ID NO: 52707 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcggattatctaaagaagtgcgcactcc

SEQ ID NO: 52708 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatcgggcatcgtagttgttcgcccttcgt

SEQ ID NO: 52709 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatctaccaggccggatgcgccaattactc

SEQ ID NO: 52710 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatctgttgtcactcagttcacgtgtacgg

SEQ ID NO: 52711 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgaataccaaccatgcggatttacactt

SEQ ID NO: 52712 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgaatctggttcccgcgacgcgaattcg

SEQ ID NO: 52713 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgaccaaaggttttcggcatgatgagat

SEQ ID NO: 52714 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgaggagtcacttgtgcacaatgacatc

SEQ ID NO: 52715 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgaggttagggattgtagtcacgctttg

SEQ ID NO: 52716 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgattgctatggctgctttctacatgtc

SEQ ID NO: 52717 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgcaaaacacacagacagctaaagatgt

SEQ ID NO: 52718 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgcaccgcgaacctgagaatagcgtacg

SEQ ID NO: 52719 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgccacattcttgctcttcagtcagtca

SEQ ID NO: 52720 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgcgcgcaaagcaccgcccaattcgtat

SEQ ID NO: 52721 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgctatggttaaccggggtcctatcgtc

SEQ ID NO: 52722 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgcttggcggttcagggtggacctacgc

SEQ ID NO: 52723 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatggattggggcgtgtccagagcatcatg

SEQ ID NO: 52724 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatggcaagagagtggtgggccactgtctc

SEQ ID NO: 52725 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatggctttcttggttgggagttggagagg

SEQ ID NO: 52726 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatggtatatttgcggtttacagttctctc

SEQ ID NO: 52727 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatggtcagggcctgaaactgcgtacgggt

SEQ ID NO: 52728 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatggttatggacctacgttgcgtcaggta

SEQ ID NO: 52729 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgtacaattttggaacactcatttccgg

SEQ ID NO: 52730 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgtagccgtgcaacagatttccgtcggg

SEQ ID NO: 52731 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatgtgttcggtgtaggtccgtctttgcgg

SEQ ID NO: 52732 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattcccgccggttacattctgtcccaggg

SEQ ID NO: 52733 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattcctcgtgtccactaaggataagggga

SEQ ID NO: 52734 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattcgtaagaacacaccaggtgcaccgtt

SEQ ID NO: 52735 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattgatcgcattcacatacggctatcagc

SEQ ID NO: 52736 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattggaatcttatctcctctaatcaactc

SEQ ID NO: 52737 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattggtgaacggcaggatcggcacaagtt

SEQ ID NO: 52738 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtattgtaggttatcaaggtaatgggctcac

SEQ ID NO: 52739 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatttaacgaacacacgtatttaagggaag

SEQ ID NO: 52740 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatttatgagtgctggatcggtcttatgtt

SEQ ID NO: 52741 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtatttgtagcgtttttttccacccgagttc

SEQ ID NO: 52742 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaaaactgcgaggggaatgggcattttac

SEQ ID NO: 52743 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaaaacttgaacgagcgggtgtacggtgt

SEQ ID NO: 52744 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaaaatcgagttcagggggccgtttaatc

SEQ ID NO: 52745 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaaataggtgcgttgacggctgaaaccaa

SEQ ID NO: 52746 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacacaaagcacctgcccaagagggggt

SEQ ID NO: 52747 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaaccatagacaccacaatgaggctacgg

SEQ ID NO: 52748 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacccagttatagcgatctagtatatct

SEQ ID NO: 52749 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaaccgtatatgtagcatgcgtttacacc

SEQ ID NO: 52750 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacctgctgatacgacttgcattatctc

SEQ ID NO: 52751 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacgcagattatgtggaattggtagtct

SEQ ID NO: 52752 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacggccgcaaacgggtggtcgggaggg

SEQ ID NO: 52753 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacgttaattatacaatccctctcgacc

SEQ ID NO: 52754 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaacgttgcagagggtataggggtccgac

SEQ ID NO: 52755 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaactcaattttgtggactcgttaacgcg

SEQ ID NO: 52756 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaagcttgggtatctacagtcggtttagt

SEQ ID NO: 52757 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaagggatcgatacacactataagcttgt

SEQ ID NO: 52758 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaatataggcgtgagctggacgccgtatc

SEQ ID NO: 52759 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaatgactgggtctaaggatcgccttcat

SEQ ID NO: 52760 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacaaggtgatcctcgccctagtattgcg

SEQ ID NO: 52761 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacaccctcagcaatgccccccttcgccc

SEQ ID NO: 52762 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacactgctggaagcgagtttccgatact

SEQ ID NO: 52763 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacagaagagacgaaatgaggcgcttggg

SEQ ID NO: 52764 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacatcgaacctgacttggccatgctctg

SEQ ID NO: 52765 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacatcgccagtgaccacgtcgtagcccg

SEQ ID NO: 52766 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacatgagggtttgagggggaaccattcg

SEQ ID NO: 52767 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacatgtgatctggtcgcggcacgggctg

SEQ ID NO: 52768 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacattatgtcggccatcgctgtgtaatc

SEQ ID NO: 52769 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaccagcgcgtgtcaccaacttgcacgcc

SEQ ID NO: 52770 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaccgcgatctccttgtattctggcgtcc

SEQ ID NO: 52771 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaccgcgcgtggggaaggatgtggggtat

SEQ ID NO: 52772 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaccgtcgtacggccgtacggatcgcggg

SEQ ID NO: 52773 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacctcatttgcgtgggactacatcatcg

SEQ ID NO: 52774 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacgaccttcagtctagtctgacttaagg

SEQ ID NO: 52775 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacggcgacgatcgctccaggtccgcacg

SEQ ID NO: 52776 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacggcggccataaggttccggtcacctg

SEQ ID NO: 52777 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacggtaatgtgtcataacgtgctcaatc

SEQ ID NO: 52778 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcacggtggcacggggtcgagcgtgtaacg

SEQ ID NO: 52779 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcactgtgttctgttatgtttcggcaatcg

SEQ ID NO: 52780 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagaaatgaagggtttgcgagctcaccat

SEQ ID NO: 52781 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagacgaacgataacgcagattacctcgt

SEQ ID NO: 52782 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagagggtgcggttgatttggttctaaga

SEQ ID NO: 52783 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagagttcgattcttccgtcctgattctt

SEQ ID NO: 52784 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagatgggagaagcattcgggcaacatga

SEQ ID NO: 52785 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagcagacctcccagctctttcgtcgaga

SEQ ID NO: 52786 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagcctttcgagcaatgtcgctggcgtgt

SEQ ID NO: 52787 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagcgccagctcgaacgcagttcctcacg

SEQ ID NO: 52788 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaggccaagcgcacgctgaatggtgtggt

SEQ ID NO: 52789 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaggctgaattaccactctcgccgtgtta

SEQ ID NO: 52790 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagggaatggacaaaggagcaccctgaag

SEQ ID NO: 52791 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagggccttcccaaaccctttatggattg

SEQ ID NO: 52792 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaggtggacatcgcgctatttctgagggc

SEQ ID NO: 52793 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcaggttacttttatctttcactaatggtt

SEQ ID NO: 52794 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagtacgagtgcacgtaaacgcgctgatg

SEQ ID NO: 52795 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagtcagtggtcaacaaatcggaaaagct

SEQ ID NO: 52796 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagtgcagggggcgtattaaaagacctcg

SEQ ID NO: 52797 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagtggacatattcatccagtcggacaac

SEQ ID NO: 52798 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagtgtatgtactacgtgacaacaaacga

SEQ ID NO: 52799 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagttacgacgcaattctgttaagtcgga

SEQ ID NO: 52800 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcagttttctaattcgctagttgcgtgatc

SEQ ID NO: 52801 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatagacgttttcggacagttgagcgctg

SEQ ID NO: 52802 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatagatgcgtagtctttcgaaccagttt

SEQ ID NO: 52803 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcataggacgcggggcgcgttgcggtaagc

SEQ ID NO: 52804 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcactctcccgtgtatcgattgacttc

SEQ ID NO: 52805 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcattctcccgagtaggcttctggaca

SEQ ID NO: 52806 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcgacgggatctgaaaggggtccaggg

SEQ ID NO: 52807 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcgagcaagaacctgaccgttatcgca

SEQ ID NO: 52808 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcgggtaaggtctcgggccttatgggt

SEQ ID NO: 52809 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcggtaccgtgattcatgtttcccggc

SEQ ID NO: 52810 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatcgtgcctgagtcttggctctaatgag

SEQ ID NO: 52811 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcatgtacaagtttgataccttggttttcg

SEQ ID NO: 52812 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattagccgttcgtctgccctcgtttggt

SEQ ID NO: 52813 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattagtgaagttaagcatagaccagtgg

SEQ ID NO: 52814 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattatcggacggcgctatatgttctgtc

SEQ ID NO: 52815 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattcagatctccacggatactcgcgctg

SEQ ID NO: 52816 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattctgcaatatctagccgatccgccgc

SEQ ID NO: 52817 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattgcatatccgccagcttagtcttgta

SEQ ID NO: 52818 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattgcgttaaactgaaatagatccgccc

SEQ ID NO: 52819 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcattggcatcaaatcactagtgctcatcg

SEQ ID NO: 52820 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaaagcgtgtccgtggttgaggcgctgg

SEQ ID NO: 52821 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaacataatcttggtgaggttgccgcgt

SEQ ID NO: 52822 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaagaacttgcactgggttcacaaggga

SEQ ID NO: 52823 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaagcttattaaaaatattgctagtggt

SEQ ID NO: 52824 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaattaaaccggtcacgtgagtgtggga

SEQ ID NO: 52825 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaccatgctttcggtcacctcagagatc

SEQ ID NO: 52826 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccacttagcgcgtagttcgttttcgacca

SEQ ID NO: 52827 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccagatacgttgctagtgctcttagatgc

SEQ ID NO: 52828 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccagctacgttacttcagttgccggttct

SEQ ID NO: 52829 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaggacgaagtcggggatgtcatcgtct

SEQ ID NO: 52830 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccagggccggcgtcgacgtcaacgcgcgc

SEQ ID NO: 52831 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccaggtagtcgtgataactagcggcacgc

SEQ ID NO: 52832 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccagtcaagctactcgcacaggcggggag

SEQ ID NO: 52833 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccagtggtggcagaggtaaggcacggaaa

SEQ ID NO: 52834 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccatatgcgcgccctatgctgacgcattc

SEQ ID NO: 52835 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccatcgcctcaaaacgttgtactagcgct

SEQ ID NO: 52836 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccatctgcctccgaatcggcggtactgtc

SEQ ID NO: 52837 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccatttgcactctgtagtagcggacgccg

SEQ ID NO: 52838 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcccaacgtagtattttacattggagttcg

SEQ ID NO: 52839 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcccattgagtttcgagcagcggttgttac

SEQ ID NO: 52840 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccccgttggctagctcgggtacaggggga

SEQ ID NO: 52841 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccccttcacgttaagatgctatataagta

SEQ ID NO: 52842 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcccggaagaacggtggaacgtgtatcgtg

SEQ ID NO: 52843 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcccggatatcttccacctgtcagctaagg

SEQ ID NO: 52844 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcccggcatgcacatagctttcggggcggg

SEQ ID NO: 52845 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcccggcctgaggtcagacgattacccgct

SEQ ID NO: 52846 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgaacacacgttaaataaggggatggcg

SEQ ID NO: 52847 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgacaccaacagtcacgacctagggggg

SEQ ID NO: 52848 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgacgcttgtgcctgaagtacctgtcgt

SEQ ID NO: 52849 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgacgggtgttcgttgcacctggcgatg

SEQ ID NO: 52850 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgacgtggaggcgaaggcgcgttgcaca

SEQ ID NO: 52851 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgatatgggcagcggtctaggcctacga

SEQ ID NO: 52852 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgatgatcaagcacagagtacggatcta

SEQ ID NO: 52853 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgcagagagtgaccttaataaagacagg

SEQ ID NO: 52854 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgccccgcatgcagagaaggtggacagc

SEQ ID NO: 52855 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgccgagccggtcgcttatcgccaggcc

SEQ ID NO: 52856 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgcgccagtcaaggtgttaaaatgggag

SEQ ID NO: 52857 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgctaccttctcgcgcttgagttaactt

SEQ ID NO: 52858 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgctggagggcgcaagggagcaacgagt

SEQ ID NO: 52859 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccggaacaagctttacgccacaaacggac

SEQ ID NO: 52860 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccggaatgcaggcggagcccagcaagatg

SEQ ID NO: 52861 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccggctcgcagcacgcgttggtgtcctaa

SEQ ID NO: 52862 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccggctgtacttatctttagttttgatta

SEQ ID NO: 52863 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgggacgacgagtttaggagtgtatcgg

SEQ ID NO: 52864 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccggtcacagttgcaattgcctaacaacc

SEQ ID NO: 52865 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccggttaaggacaatatggagactctatg

SEQ ID NO: 52866 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgtgcgcctgtttgaccacggggggtat

SEQ ID NO: 52867 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgtgctggtgggcttcttaaattgttca

SEQ ID NO: 52868 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgttgcggtacgcataaactcttagcgc

SEQ ID NO: 52869 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgttgtgggcacaggcacagacgtgttt

SEQ ID NO: 52870 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccgtttcagtataaattcggtattctgtt

SEQ ID NO: 52871 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctaagcgaaatacgcaggccacatcctg

SEQ ID NO: 52872 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctaccaatcgtgctgtcctcctggtgtg

SEQ ID NO: 52873 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctatgcaacgagcgggcgaaggcactcc

SEQ ID NO: 52874 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctccgctcgggtgtgtgtctgcaaagtg

SEQ ID NO: 52875 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctcgatagtcggtggtctgcggcgccgt

SEQ ID NO: 52876 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctcgatttaacgtccgggcttgtctaac

SEQ ID NO: 52877 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctcgccctctagattgctattttggttc

SEQ ID NO: 52878 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctgaagacccttgacggcggctggtgga

SEQ ID NO: 52879 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctgaatggaactgcccgcactaggtctg

SEQ ID NO: 52880 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctgatctccacctgatctgcagtctctg

SEQ ID NO: 52881 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctggagggggattggacttgggttcagg

SEQ ID NO: 52882 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctgtacaccgatcgctggggtcgcactt

SEQ ID NO: 52883 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcctgtgctggtagtcgcatctgtagttcc

SEQ ID NO: 52884 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccttgcacgcttggatctacctgttcttt

SEQ ID NO: 52885 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtccttttcgtggatcgtttgcttggggtcc

SEQ ID NO: 52886 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaaacacttaacgtgcaaagcgcagacc

SEQ ID NO: 52887 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaacctttgctcatccggcacccgcacg

SEQ ID NO: 52888 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaacgcttgctgcacttacactcgttcg

SEQ ID NO: 52889 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaagtgcaccctctcgccgtgattgtga

SEQ ID NO: 52890 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaatgattagatttagaggcggtactta

SEQ ID NO: 52891 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaattagtagtaattaagagggtgagcg

SEQ ID NO: 52892 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgacacgctagactcgtgtttcctcggtg

SEQ ID NO: 52893 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgacatgggatacctagtccgcggaggat

SEQ ID NO: 52894 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgacgcagcaccggcatcttgatcggcaa

SEQ ID NO: 52895 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgacggcgcgatggaatagtagcacgggg

SEQ ID NO: 52896 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgacgggaaacagacgtaacgtatcgacg

SEQ ID NO: 52897 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgacttacgagaggtgcactttccaacgt

SEQ ID NO: 52898 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgagacgaacagcctatttggtatttctc

SEQ ID NO: 52899 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgagccggtgcacagcgcgtcagacctgc

SEQ ID NO: 52900 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgaggttcgagattccactgtgctcgttg

SEQ ID NO: 52901 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgagtccgtgctcttgtgacccgggcgcc

SEQ ID NO: 52902 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgagtgcaggttgggttccagaagagtca

SEQ ID NO: 52903 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgatcgctgagcgggcggactcgagctgg

SEQ ID NO: 52904 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgatcgcttacatccacccgggtgctatg

SEQ ID NO: 52905 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcaaacaagtggctgtatggtcagtctg

SEQ ID NO: 52906 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcaaacgcatgtaacacgacgagagact

SEQ ID NO: 52907 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcaattggaatcgcctactagtgggttg

SEQ ID NO: 52908 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcacaccaccttgccaccgggattggga

SEQ ID NO: 52909 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcaggcgtctacgacggcacacccgggc

SEQ ID NO: 52910 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgccaaggggattcccatcgccgtggaaa

SEQ ID NO: 52911 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgccagccgaggtgtctaatgcggggagg

SEQ ID NO: 52912 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcccaactgcaggaccgatcgtgcgatg

SEQ ID NO: 52913 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcccgacaagcggttcagtctgtcaact

SEQ ID NO: 52914 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgccgatagacaaagctcgaccgcgcacg

SEQ ID NO: 52915 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgccgtctttgctggaatcttgcactgat

SEQ ID NO: 52916 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgaagtttcttcattaccggtgttgcg

SEQ ID NO: 52917 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgaccacgatagcctatccggacttgc

SEQ ID NO: 52918 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgacgtgccatgagctgtatgcacagg

SEQ ID NO: 52919 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgagcagggcgtgtcttgacgtacacc

SEQ ID NO: 52920 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgcctgactctagtctgcttggtgatt

SEQ ID NO: 52921 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgcttctgcttagacttcaggattttg

SEQ ID NO: 52922 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcggctgcatcgtgaatgtgtatgagtg

SEQ ID NO: 52923 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgggcttgggacacctgtcggtgccgg

SEQ ID NO: 52924 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcggggttgaaacgttggatctgtgctc

SEQ ID NO: 52925 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcggtacatgtttttacggttgaccctg

SEQ ID NO: 52926 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgtaatgcgtgcgtcatcttcttaaga

SEQ ID NO: 52927 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgtatctgactttgacatccggggctc

SEQ ID NO: 52928 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgcgttttaccacttgtcaggactgcgga

SEQ ID NO: 52929 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgctatggtcgagcacggaggccccaaac

SEQ ID NO: 52930 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgctggcacctgacacatttgttcggcct

SEQ ID NO: 52931 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggaagagctctggggctattaaagcaaa

SEQ ID NO: 52932 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggacacagggaagggcgactctgatagc

SEQ ID NO: 52933 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggagacgaataatgcctagcttctagtt

SEQ ID NO: 52934 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggagtcgttagcgcgtggtcatcgctcg

SEQ ID NO: 52935 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggagttgtgagcgcgtggttggtacctc

SEQ ID NO: 52936 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggatgatcgcgtggttagcgggtcaggg

SEQ ID NO: 52937 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggatgcaaggttcgaatcgccgaatcca

SEQ ID NO: 52938 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggcagggtgtgtgcggaaacgcgccggg

SEQ ID NO: 52939 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggcgagtgtcagtcaatttgcaaggcaa

SEQ ID NO: 52940 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggcgcacgcccacgcggtttacaggatc

SEQ ID NO: 52941 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggcgcgcgtttgactggcccagttcccc

SEQ ID NO: 52942 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggcgtgttcgaagcagtggggtcacatg

SEQ ID NO: 52943 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggcgtttcgtgattaagtctgagcttcc

SEQ ID NO: 52944 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggctgcagtatttgtagtcattggcggg

SEQ ID NO: 52945 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgggagacgtagcgcgacagttcctggta

SEQ ID NO: 52946 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgggcacttacaccgttcctggtagttat

SEQ ID NO: 52947 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgggcgccaagctcgggcttcgacatgag

SEQ ID NO: 52948 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggggaacttcttcgcagggcgactcggg

SEQ ID NO: 52949 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggtcaaactgttggtcgactgattcctg

SEQ ID NO: 52950 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggtcagtcggaataaattacggtcgcgg

SEQ ID NO: 52951 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggtcatattgcgcacaattcggtacaga

SEQ ID NO: 52952 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggtcctcacataagggcctgatgggacg

SEQ ID NO: 52953 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggtgtggggtaggatgtccctcgtcctg

SEQ ID NO: 52954 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcggtgttgtcatttcatccgtgaatactt

SEQ ID NO: 52955 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtaagccctcctattagggctagagtgc

SEQ ID NO: 52956 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtaatcaatggcggggtagtgtgtacat

SEQ ID NO: 52957 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtcaaacggataccaagagtcgtacacc

SEQ ID NO: 52958 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtcccaagatatttgagtctacataccc

SEQ ID NO: 52959 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtcccaggcagcggtctctcgcactgca

SEQ ID NO: 52960 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtccgcgggaacgtatgtcgcaagcgcc

SEQ ID NO: 52961 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtcgaaatccggttccttacaagcatcg

SEQ ID NO: 52962 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtcgctatattacggttcactatctacg

SEQ ID NO: 52963 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtcgctggcattacaattaggcaaggag

SEQ ID NO: 52964 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtctcacccgtctgtgtaatttgacgtt

SEQ ID NO: 52965 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtctctcttgtctaccgtacctgtttgc

SEQ ID NO: 52966 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtctgaaatcaacgagacattttactgg

SEQ ID NO: 52967 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtctggcgaggtgggctcatacaggccg

SEQ ID NO: 52968 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgcagcggtccccgttgtgttcctgat

SEQ ID NO: 52969 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgcattcgtacggctatgggtgaagcc

SEQ ID NO: 52970 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgccctcttagcgcaattggttactgt

SEQ ID NO: 52971 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgccgtgacgtatcgcccgtgcacacg

SEQ ID NO: 52972 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgctgtccgcatacggtaatgccctcg

SEQ ID NO: 52973 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgggagtgacggtcgagacatacccat

SEQ ID NO: 52974 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgtagcagatcgcccgggatgttctcc

SEQ ID NO: 52975 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgtccatccaaatgcagaggcctcttg

SEQ ID NO: 52976 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgtgttaggatccggtgccgggtgggg

SEQ ID NO: 52977 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtgttactaagttacgtggagtgcgtta

SEQ ID NO: 52978 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgttcgagcagactggctcattggacctt

SEQ ID NO: 52979 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgttcgctcgggactctttggtcgtgagg

SEQ ID NO: 52980 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgttcggggttacgtgcgcgggtggcgcc

SEQ ID NO: 52981 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgttcgtccgagatgttcgttttttggca

SEQ ID NO: 52982 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgttgttagacgagttttcgtccactttc

SEQ ID NO: 52983 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcgtttcaactgatgttcgtaagggtttat

SEQ ID NO: 52984 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctaaccaatagccacactcatcgcttggc

SEQ ID NO: 52985 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctaagggtcatccgaactctacgccctca

SEQ ID NO: 52986 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctaaggtgttgggtgaggggagtgtcttt

SEQ ID NO: 52987 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctaagtaacgctcgctcttggggttccat

SEQ ID NO: 52988 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctacatcaagccttgtgccggccgccttg

SEQ ID NO: 52989 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctaccggtgtacattattgtaatccatag

SEQ ID NO: 52990 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctaccgttgaccgttggattgattgaata

SEQ ID NO: 52991 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctacgatcgggcttggacgattgcaccgc

SEQ ID NO: 52992 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctacgatgttaataggtctgatgggcctc

SEQ ID NO: 52993 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctacgccacgatagggctccttggtgtgg

SEQ ID NO: 52994 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctactctctgcataaatataggttttctc

SEQ ID NO: 52995 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctagcaacttgggggcttctagtcacgga

SEQ ID NO: 52996 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctatgctgtagatgtcggttccttagaga

SEQ ID NO: 52997 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctattcacgctgagggttccttaggatag

SEQ ID NO: 52998 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcaaagtgtagtgggcgcatgacattgt

SEQ ID NO: 52999 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcaactcgcgcaacatgggtttaactcc

SEQ ID NO: 53000 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcaaggtaggtagtatccgtccagttgc

SEQ ID NO: 53001 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcaatgcggatagcgaaggcgtgcgtcc

SEQ ID NO: 53002 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcagtccgtcacagccggtagctgattg

SEQ ID NO: 53003 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcatcaacaagtcaggcattatactttt

SEQ ID NO: 53004 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcatggttcgcgctttcgcagaaggaga

SEQ ID NO: 53005 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctccgtatgcattctcgattccatcccgc

SEQ ID NO: 53006 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctccttcgtatgaacgtgagtgtgttact

SEQ ID NO: 53007 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcgcaaaggtgatcgttagcctgcagtg

SEQ ID NO: 53008 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcggttcagacgcgctctaagtccgtgt

SEQ ID NO: 53009 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcgtaacatcgatgctgttgctataggt

SEQ ID NO: 53010 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcgtagattagccgtatgctaattaacc

SEQ ID NO: 53011 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcgtgccgcgagtctgtttccgttgtgg

SEQ ID NO: 53012 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctctcggttggtcttgttatctctgcggt

SEQ ID NO: 53013 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcttatgcacttgttctttgttcgattt

SEQ ID NO: 53014 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctcttcgcggcgcctaatacttctcggtc

SEQ ID NO: 53015 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctctttttcagtatagtacgagcgtaagc

SEQ ID NO: 53016 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgaagggggtggtggactgtcttgtacc

SEQ ID NO: 53017 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgaattcctggggatatgtcgacggggg

SEQ ID NO: 53018 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgacactcacgacagtcgcccctcattc

SEQ ID NO: 53019 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgacccattacgattaggcgtcttatgt

SEQ ID NO: 53020 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgagtagatgacgtgctaccatgggact

SEQ ID NO: 53021 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgatgtttggcgccacttacccagcaat

SEQ ID NO: 53022 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgcccatgtcaggaatttgtttagcctt

SEQ ID NO: 53023 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgcctagcggtggcgattttgtccagtg

SEQ ID NO: 53024 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgcgaagcctagttgctaagtgttcctc

SEQ ID NO: 53025 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgctggtcagctccgttgggcagtgtat

SEQ ID NO: 53026 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgctttctcagatcacggttgggtagct

SEQ ID NO: 53027 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggacagccggcagacctgcggatggcg

SEQ ID NO: 53028 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggacgggggcggttagtgtagggcagc

SEQ ID NO: 53029 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggatgttcggcagcggaatcttcggca

SEQ ID NO: 53030 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggcgatttgataaagcttgtgctggac

SEQ ID NO: 53031 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggcgtgacacaagtgggagtgcacttg

SEQ ID NO: 53032 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgggccgcggggtttcgaagcagatgcg

SEQ ID NO: 53033 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggggagtggtatagaggtcatcgcgtg

SEQ ID NO: 53034 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgggtataggctcagggtcatttcaggg

SEQ ID NO: 53035 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgggtgtagccatgcggtcaaactctcg

SEQ ID NO: 53036 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgggttgtttgggtctgtatcatcccgg

SEQ ID NO: 53037 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggtcggcttatttcttaacgttcgagt

SEQ ID NO: 53038 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggtctccgctctcttgcgaaagcctct

SEQ ID NO: 53039 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctggttaggcattcatacgggtgcgggta

SEQ ID NO: 53040 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgtaccatctgtcaattgtggcctcttt

SEQ ID NO: 53041 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgtcactttgatcgataacagttttccg

SEQ ID NO: 53042 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgtctgaaggtggcgcactatatttcgc

SEQ ID NO: 53043 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgtgcccttgcgtaccagtctccgcatc

SEQ ID NO: 53044 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctgtggtatagtaatgagttctccgaggt

SEQ ID NO: 53045 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttaagacatgttagaccttgccagtcgt

SEQ ID NO: 53046 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttatggcaaggaacgtacggttagctat

SEQ ID NO: 53047 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttctgctccagattggcgtgggtggagt

SEQ ID NO: 53048 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttgcaaatcatgaagatgggattttgtt

SEQ ID NO: 53049 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttgctagggagcggcacacatggagacg

SEQ ID NO: 53050 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttgcttggatgtacgggtcttacttgcg

SEQ ID NO: 53051 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttggcaactatgtcggcacgttcatctg

SEQ ID NO: 53052 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttggggctaaaaggtaacccttgcatgt

SEQ ID NO: 53053 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttgtaactagcgtccgtgtctaaaactg

SEQ ID NO: 53054 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttgtgttggatcactacctaggggcgca

SEQ ID NO: 53055 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctttattgtttcacttatggggactgccg

SEQ ID NO: 53056 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtctttggcgtcaatcttctagacttggact

SEQ ID NO: 53057 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtcttttcacagcagtaaggtctgctacggt

SEQ ID NO: 53058 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaaaaacctcagcacccgatgtacatgc

SEQ ID NO: 53059 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaaatgtcttccgagcacggcatacgct

SEQ ID NO: 53060 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaaccgaatcttgacgcgctccgggatc

SEQ ID NO: 53061 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaagacgccatttttttcatgtagtacc

SEQ ID NO: 53062 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaatgccatttaggtgagcgcaaaaggg

SEQ ID NO: 53063 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaattttagtccaagacaagcgaggcca

SEQ ID NO: 53064 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacaagtggcgtgggcatgactacggta

SEQ ID NO: 53065 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacagccttgcttaatgcactgcggcgg

SEQ ID NO: 53066 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacagtcggtccacgcatgatctagcac

SEQ ID NO: 53067 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacagttccacgcgcgccagttaaggtt

SEQ ID NO: 53068 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacatgcgcccagttcatgttattgtct

SEQ ID NO: 53069 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacatgttgaccaaggacattgttaatg

SEQ ID NO: 53070 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaccggatgtgcgcgtgcattaacacgt

SEQ ID NO: 53071 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaacggcgctaactaacgagacggatgtg

SEQ ID NO: 53072 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaactgccggaatggtctggagtccaggc

SEQ ID NO: 53073 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaagacacatcttgccagggtgatgcgtt

SEQ ID NO: 53074 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaggaacctgcgtatctggatttggggt

SEQ ID NO: 53075 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaggcacacctcttgacttggaacttgt

SEQ ID NO: 53076 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaaggtgtcccgagtttgtggcgttggaa

SEQ ID NO: 53077 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaagtccaatgaccagtcttggtccagtc

SEQ ID NO: 53078 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaatcggttcgctaggcgccaaacacttc

SEQ ID NO: 53079 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacaatgagtgacggggcggcccacgggt

SEQ ID NO: 53080 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacacatgtcctttgtgcacgttaccgcc

SEQ ID NO: 53081 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacaccgaatgagaagtgcaccagcgtgg

SEQ ID NO: 53082 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacacgccgtgttattgctcgtcctccac

SEQ ID NO: 53083 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacacggtgacatggggaaggcgttggat

SEQ ID NO: 53084 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacaggtagcggcgacgcgttctgtccgg

SEQ ID NO: 53085 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacaggtgccttaatgttgctggggtgac

SEQ ID NO: 53086 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacataactgtatgcgaatgaggggcatt

SEQ ID NO: 53087 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaccaagccggtttcccttccgcgttacg

SEQ ID NO: 53088 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaccactgcctaagaatacatagacgttt

SEQ ID NO: 53089 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaccagagccgcgacatgcgtcaaacgtt

SEQ ID NO: 53090 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacccggcggagctactgcgcatatgact

SEQ ID NO: 53091 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaccctgtaccaatgggcgagcttgggcc

SEQ ID NO: 53092 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaccgaatgctcaaatcgggtaatttcat

SEQ ID NO: 53093 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgaaaccgcctatttaccggccacctg

SEQ ID NO: 53094 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgaatcgtccagtggcggtccgacgtt

SEQ ID NO: 53095 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgcaacaaggaaactagaatgtccctt

SEQ ID NO: 53096 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgcaaggtaacgagcaggctcatgttg

SEQ ID NO: 53097 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgctgttttcagtgggggcttgccttc

SEQ ID NO: 53098 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacggcgcatagttcgaacgagacacatc

SEQ ID NO: 53099 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacggcgtcaggctcattgtagggatacc

SEQ ID NO: 53100 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacggtctgtagtactgggcaaggtggtc

SEQ ID NO: 53101 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgtcgggccggtctgataggcttggat

SEQ ID NO: 53102 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgtcggtgctgaccttagcagcattct

SEQ ID NO: 53103 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacgttgagctggagagcacgctgtatgg

SEQ ID NO: 53104 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgactaacagcccgctatcaggtgtatcga

SEQ ID NO: 53105 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgactagttcggtctccaagtgcattggta

SEQ ID NO: 53106 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgactcaccgcgttcgttcatggccagaca

SEQ ID NO: 53107 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgactcgagaatgtgattgattgccgcgaa

SEQ ID NO: 53108 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgactgcagatcttcaagcgtattagattg

SEQ ID NO: 53109 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacttacgcgcccaatgcggttcggtcgc

SEQ ID NO: 53110 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgacttaggtatgctcacaaccctggcgct

SEQ ID NO: 53111 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagaacacggtagccggtcgcccactgct

SEQ ID NO: 53112 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagacaaagactagggcacggggctcaat

SEQ ID NO: 53113 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagattatgcgaatttagagtactggttg

SEQ ID NO: 53114 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagcacgtttacgggtaatgcggtctctg

SEQ ID NO: 53115 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagcaggcaagtgcgcgcttaccggtctc

SEQ ID NO: 53116 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagcctgatagaaaggtcccgccgtcaga

SEQ ID NO: 53117 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagcgggcacattacacgcagtctggtgg

SEQ ID NO: 53118 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagctgagtcagtgcgtcggtccatacga

SEQ ID NO: 53119 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaggagcaaccgcttcaccacttcgtgta

SEQ ID NO: 53120 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaggagcacctcgtaagaattgacttgtc

SEQ ID NO: 53121 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaggatcatgaagctcttctgacccgcac

SEQ ID NO: 53122 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagggcaatcggtgagagactaggagttt

SEQ ID NO: 53123 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgaggtacgtagtgcgtcgtaccgggtcgg

SEQ ID NO: 53124 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagtactggcacggaacggcagtaaggtg

SEQ ID NO: 53125 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagtactggggggactctccaaatgtact

SEQ ID NO: 53126 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagtggcaaaagtacacacgctttaggat

SEQ ID NO: 53127 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgagttcacgcaaccctgcctgggcggacg

SEQ ID NO: 53128 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatacattggtatgatgagtttcgtggtt

SEQ ID NO: 53129 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatatgatgcgggttcgttgctctgcgtt

SEQ ID NO: 53130 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatatgtatgattagctagtgcccttctg

SEQ ID NO: 53131 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatcagtcgtcgggggacgaaagttctga

SEQ ID NO: 53132 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatcgcgactcgtaggtgcgaattcggta

SEQ ID NO: 53133 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatcgcgcggactgagcttgccgtgggcg

SEQ ID NO: 53134 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatctgtaccggccgcttgttcgcgacct

SEQ ID NO: 53135 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatgcgctaaagatggtgggggtttacgg

SEQ ID NO: 53136 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatggcccatacgagttcgttgtttgatg

SEQ ID NO: 53137 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatggcggtaccatgtctcgtgctaggag

SEQ ID NO: 53138 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgatgggcagagatggcaggtcggttgttc

SEQ ID NO: 53139 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgattgattattggggttattataacatct

SEQ ID NO: 53140 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgattttcaattccactctcagcctattat

SEQ ID NO: 53141 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcaagctgtccatcttgaccggcgccacc

SEQ ID NO: 53142 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcaaggcgttagtcattgtcgggcttggg

SEQ ID NO: 53143 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacaatttggtcaaccttggagctggtc

SEQ ID NO: 53144 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacacgagtgacgatagaatggctgcca

SEQ ID NO: 53145 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacatggttcgcagtcttgaggatcctt

SEQ ID NO: 53146 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacgcatcagtgtctggtaacatttgtc

SEQ ID NO: 53147 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacggctgtcgtttgctgctgcgccaca

SEQ ID NO: 53148 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacgggcttgtttgaaggtgctcggagg

SEQ ID NO: 53149 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacggtacgcgaatcttcaaggtgcagt

SEQ ID NO: 53150 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcacggtagggtctttactcccttgctag

SEQ ID NO: 53151 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcactatggccatactagcttggaatggg

SEQ ID NO: 53152 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcagaccgtacagatcgtttcaccacgtc

SEQ ID NO: 53153 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcagagcgctcaacggatgctgtgcccgg

SEQ ID NO: 53154 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcagcaaaattttcacaagggcaagggac

SEQ ID NO: 53155 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcagcaatgagaactaaatatgtaaggcg

SEQ ID NO: 53156 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcagccacactatccgtttgattgttccg

SEQ ID NO: 53157 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcaggaggtggctgcaagggtagcacgga

SEQ ID NO: 53158 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcaggccggacaaaatgctatgcttcgcc

SEQ ID NO: 53159 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcaggctcgttaatgtcccttacgcgcat

SEQ ID NO: 53160 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcaggggtactcacactcttgaaagcggt

SEQ ID NO: 53161 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcagtcatggtagtatttggtctaccacg

SEQ ID NO: 53162 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcatactgtagctcacggcgtggtatcaa

SEQ ID NO: 53163 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcatcgtgcctggactctttccgccgcgg

SEQ ID NO: 53164 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcatgtggttcgagtaatgccgagtttct

SEQ ID NO: 53165 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcattccttgtcttcttgcgatatcgttc

SEQ ID NO: 53166 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccacaagatgcagcaacacattgagttc

SEQ ID NO: 53167 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccacgggggagagggatctggtgaggct

SEQ ID NO: 53168 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccacgttatagtccttcggtaccaccgg

SEQ ID NO: 53169 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcccaaggtcaacttcgggcggttggggc

SEQ ID NO: 53170 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcccgtcgcggatcgttttatctcagtag

SEQ ID NO: 53171 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgaaagttgctttggtccacgtgacaa

SEQ ID NO: 53172 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgagcgtgcctggcacggatgatacgc

SEQ ID NO: 53173 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgaggtttccggtgggagctggagcta

SEQ ID NO: 53174 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgattggcgatctcgcaagcgacctca

SEQ ID NO: 53175 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgcataaggggtccgtttacggcaggt

SEQ ID NO: 53176 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgccgttaagttcgttatgcgaccagc

SEQ ID NO: 53177 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgccgttacgtagtgcgagcttgtggt

SEQ ID NO: 53178 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgcgctccggtggcatcctcggtcggt

SEQ ID NO: 53179 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgctcaaagtagtgttggcagattccg

SEQ ID NO: 53180 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccggtgatgtattcagttacggtaggac

SEQ ID NO: 53181 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgtatgaattgtcagcacatcgtttgt

SEQ ID NO: 53182 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgccgttccgggttcagcttaggccgggga

SEQ ID NO: 53183 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctacgatgacttcaaatcagccggttg

SEQ ID NO: 53184 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctagggatcaaagtatacattcgaggt

SEQ ID NO: 53185 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctattctaaaggtgcgtggcggtgtta

SEQ ID NO: 53186 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctcaacgccggggtcgcagggttgagg

SEQ ID NO: 53187 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctcactagatcgggccctgtaccggat

SEQ ID NO: 53188 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctccagtcaagtggaagtagggtgttc

SEQ ID NO: 53189 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctcgctgtgttgcatacgtcttggttg

SEQ ID NO: 53190 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctctcgatatgacttatggacgtatcc

SEQ ID NO: 53191 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctgactgcaggcatgttgtaatggggt

SEQ ID NO: 53192 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctgcaaaggacttggtttgcccggtta

SEQ ID NO: 53193 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcctgtttatcttcccgcagttctcacgt

SEQ ID NO: 53194 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgaaagcgacaagttacggggcgtgtca

SEQ ID NO: 53195 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgaagcggtggagttttgtgatgccagg

SEQ ID NO: 53196 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgaatgatttggttttccggggcgcgta

SEQ ID NO: 53197 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgagagttggactagacaagggtcggag

SEQ ID NO: 53198 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgagcgaatctgctggtcatcacgctta

SEQ ID NO: 53199 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgagttgttccgcaaggttttatcatgg

SEQ ID NO: 53200 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgatcccgcatagaccaccgtgagtccg

SEQ ID NO: 53201 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgatggaaggtccttcctagcgtaatta

SEQ ID NO: 53202 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgattttatactggagtggtgataatgc

SEQ ID NO: 53203 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgcacatacataccacgattacacgggg

SEQ ID NO: 53204 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgcagatgtcgtattggcaggctaaacc

SEQ ID NO: 53205 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgcagcggtcttatcattaccatgaatc

SEQ ID NO: 53206 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgccctggcctgtataaacctggctatg

SEQ ID NO: 53207 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgccgcggtgggtttgcttgttggaccc

SEQ ID NO: 53208 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgcctagcggactggttctggggcttgg

SEQ ID NO: 53209 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgcgtggataagttgcggtaggcgtgag

SEQ ID NO: 53210 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgctacgcatttcgctaatattgcgctt

SEQ ID NO: 53211 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgctatcaactgtgcaaaagtaagtccg

SEQ ID NO: 53212 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgctgtcaagctaaggtcagccgcagcg

SEQ ID NO: 53213 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggaagactgccatctcgttgctgcgta

SEQ ID NO: 53214 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggcacaaccagagagtttattcgacgt

SEQ ID NO: 53215 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggcacctctggatgcgctcgtgatcga

SEQ ID NO: 53216 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggcagggccatttgtagtttgactctg

SEQ ID NO: 53217 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggtcaattgttcctctcgttgagctcg

SEQ ID NO: 53218 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggtcccaaacctcgggccatggaggaa

SEQ ID NO: 53219 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggtctaggacgtatagttccgactttt

SEQ ID NO: 53220 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggtggggttgtgtttcgccgaagcagc

SEQ ID NO: 53221 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggttataacgatgtggcattagtcggg

SEQ ID NO: 53222 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcggtttaaaaaataacactctctggcct

SEQ ID NO: 53223 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgtacaatttccgataatcatacagctt

SEQ ID NO: 53224 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgtcgatgggaagttttgggctattggc

SEQ ID NO: 53225 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgtgggggatcctttgttttaagacgtg

SEQ ID NO: 53226 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgtgtgacgggtacggatctgtgctgtg

SEQ ID NO: 53227 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgtgtttgcgcacaaacaggcttcggtg

SEQ ID NO: 53228 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcgttcggcaagagcggcccggccggagc

SEQ ID NO: 53229 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctactgcggtaggtttgagacgactgca

SEQ ID NO: 53230 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctaggatcatgatgcagcgggaggacgg

SEQ ID NO: 53231 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctaggcaccgctcgctctcttgttaatt

SEQ ID NO: 53232 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctatgcggtgtgacgccttttgcatctc

SEQ ID NO: 53233 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctcacttggcttttagttatccatcccc

SEQ ID NO: 53234 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctcatatcattagggggttgtcggcgcg

SEQ ID NO: 53235 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctcatcgtactataccttgtgggccggc

SEQ ID NO: 53236 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctcggacgcaacgtctcggtgaaaactt

SEQ ID NO: 53237 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctctccctgaggtggcgctggtacagtt

SEQ ID NO: 53238 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgactacggtcttactggtcaacacga

SEQ ID NO: 53239 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgagggggcaagtgttgccggaaactg

SEQ ID NO: 53240 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgcaggtgtaatgggccagttgcgacg

SEQ ID NO: 53241 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgctcgtcatgttatgtcgtagtctgc

SEQ ID NO: 53242 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctggatacattagaccaatgacaaacac

SEQ ID NO: 53243 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgtaacgtatagagggattcgccgccc

SEQ ID NO: 53244 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgtgatacgtaggtaggatcgcgcgat

SEQ ID NO: 53245 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgctgtttcgggttcaagatggataatccc

SEQ ID NO: 53246 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcttaagccagcggtccttgtagcctatg

SEQ ID NO: 53247 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgcttggtgcaatgattgagagcgcgttgc

SEQ ID NO: 53248 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaagaacatccgggatcgggccgtaaca

SEQ ID NO: 53249 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaagagttgtttaacttcacggccaagg

SEQ ID NO: 53250 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaaggcgaagtgtccctagggggtgtct

SEQ ID NO: 53251 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaagtttagagggcgatagtccaaatag

SEQ ID NO: 53252 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaatgggatgagacagactagcatcagg

SEQ ID NO: 53253 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggacactcaggcggcgagatatagcactg

SEQ ID NO: 53254 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggacagatatggtgcatttgcccgataaa

SEQ ID NO: 53255 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaccaatggggtgtttacccttagccgt

SEQ ID NO: 53256 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggacttttcgctctcgttaggcgttcagt

SEQ ID NO: 53257 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggagcaggtgaactgaggttcttcgagtg

SEQ ID NO: 53258 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggagggggatgtgggcacctggaagcaac

SEQ ID NO: 53259 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggaggtgctagggcctgaggactgaatcc

SEQ ID NO: 53260 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggataaacggtttcgacacgcacacacta

SEQ ID NO: 53261 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggatccacaagcaatccctgcatgtcatg

SEQ ID NO: 53262 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaagcgctgacacccgcagtcagtctg

SEQ ID NO: 53263 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaaggtcacgtttcaaatttgtttatc

SEQ ID NO: 53264 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaagtgcggtcaattgatcatgcggtt

SEQ ID NO: 53265 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaatccgaagtcgcgttgttctcgaat

SEQ ID NO: 53266 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaatgtcccggatcctgcacggttgat

SEQ ID NO: 53267 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaccgggtccggaccgagtacgatctg

SEQ ID NO: 53268 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcacgattccattgagacgcggcgatga

SEQ ID NO: 53269 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcacggggtgtacgtgggagttttaagg

SEQ ID NO: 53270 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcactaggtctgaggtagtctgtacaaa

SEQ ID NO: 53271 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcagcagaatagatccaaatggtctaac

SEQ ID NO: 53272 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcagcgccggttcataaatacctgcaag

SEQ ID NO: 53273 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcagctattcagtaggatcttccatgtc

SEQ ID NO: 53274 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaggacggtccgagtattgatggtagc

SEQ ID NO: 53275 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcaggggagttccttgtgggatctccga

SEQ ID NO: 53276 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcatacacaggtgcatcgtgggttggac

SEQ ID NO: 53277 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcattgaagggcagaagcagtatagggg

SEQ ID NO: 53278 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggccaaaacatacgtatacatcagtgctc

SEQ ID NO: 53279 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggccaacggtttgacattagtccggctcc

SEQ ID NO: 53280 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggccaatttcccaaaccgccttacgcggg

SEQ ID NO: 53281 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggccatactgactgggacggcctgcatcc

SEQ ID NO: 53282 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggccccgagatgatcaactatataagagc

SEQ ID NO: 53283 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcccttatcttcgtccacgcgggcagcc

SEQ ID NO: 53284 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggccgacgtgcgccttaattatatgctga

SEQ ID NO: 53285 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcctaagcggggtcatacaacgcaggaa

SEQ ID NO: 53286 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcctgctgctggggaatgacctaggcgc

SEQ ID NO: 53287 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcgaactctaagtgcggcgctatcaggg

SEQ ID NO: 53288 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcgacatcacagatcgagggtaccccac

SEQ ID NO: 53289 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcgatccggcagtcctcgttggttcacg

SEQ ID NO: 53290 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcgcacggtctcatcgaatcagcacagg

SEQ ID NO: 53291 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcgcgcagggggtgtgagtatacgagtg

SEQ ID NO: 53292 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcgggcggagtttggtgggcgatctgga

SEQ ID NO: 53293 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcggtcgcgaggctccgggcgtgtggaa

SEQ ID NO: 53294 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctaaactccggggatgctcacagggat

SEQ ID NO: 53295 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctatccggcaactcggacactgggctg

SEQ ID NO: 53296 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctgcattcccgaatgaccatgtcacgt

SEQ ID NO: 53297 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctgccgtgatagggtgtaatctgtgcc

SEQ ID NO: 53298 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctgcgtagtcaaatgttagctcctcgc

SEQ ID NO: 53299 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctgctagggttgccgcgatagattacc

SEQ ID NO: 53300 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctggccgtgaaccaccccgccttcgcg

SEQ ID NO: 53301 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggcttgtcgcgtcggttatattagggagg

SEQ ID NO: 53302 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggctttgtgcgccaaatggtccattaaca

SEQ ID NO: 53303 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggaagtcagtggccgccgactcgtccgg

SEQ ID NO: 53304 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggacacttcgtttggatatcttaatttc

SEQ ID NO: 53305 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggacgacgggctcctggttgggggtggt

SEQ ID NO: 53306 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggacgacgtacctacgcttactgactta

SEQ ID NO: 53307 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggacgcgtcagacgttcacgagagtatc

SEQ ID NO: 53308 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggacggcgggttcggactagcaaatttt

SEQ ID NO: 53309 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggacgtatcctcgccgagttagcatgat

SEQ ID NO: 53310 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggagggagagttaagattaccgggagca

SEQ ID NO: 53311 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggatccttggcgcagtttgttgtggtta

SEQ ID NO: 53312 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcaagacggatgtgattatagcatcat

SEQ ID NO: 53313 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcagggacgactcggacatgcggcata

SEQ ID NO: 53314 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcatcacaaagctgttggaaaggccgc

SEQ ID NO: 53315 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcccagcgaacgcggtgtcattttgtc

SEQ ID NO: 53316 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcctaagtacaccttacgagggtcctg

SEQ ID NO: 53317 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcctaggtattaactgtttttatcttc

SEQ ID NO: 53318 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcgggcgcgcttgtgctgactcgagtg

SEQ ID NO: 53319 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggcggttcccctccaaaggtgcgagttg

SEQ ID NO: 53320 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggctcaacatcatcgggaaggtcgtgtc

SEQ ID NO: 53321 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggaaagaggtaggcccctataagcgtg

SEQ ID NO: 53322 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggaacgtgagaggctagggaaatgtcg

SEQ ID NO: 53323 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggaaggttcaacggaacacgggtgtac

SEQ ID NO: 53324 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggaggccgttactccgcgtaccaccac

SEQ ID NO: 53325 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggcaaggtcttcttcggctctatcgtc

SEQ ID NO: 53326 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggctcagcgtcgacgcactgggagggt

SEQ ID NO: 53327 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggggaaacactgcgaggctggatccggg

SEQ ID NO: 53328 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggggctagcggaacgacgtgatgtcgcg

SEQ ID NO: 53329 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggggctggacctcgcgcgtcggcaactg

SEQ ID NO: 53330 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggggctggcagaggtggccgcgctgtgg

SEQ ID NO: 53331 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggggtgatggatagggagccagaggtcg

SEQ ID NO: 53332 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggggttgagccagtctacggcggtgatc

SEQ ID NO: 53333 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggtaaaggggaaggattggtgcgacaa

SEQ ID NO: 53334 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggtatttttttcctggcccttcaccct

SEQ ID NO: 53335 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggtgccatacgagggatgcctggcgag

SEQ ID NO: 53336 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggtgccgtttgtcccggacatcgaaat

SEQ ID NO: 53337 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggggttccggaggtacgctgtatagagcg

SEQ ID NO: 53338 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggtcacacggtttgcatgcctcatccgc

SEQ ID NO: 53339 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggtcgcggggtctcggagtgatcgcctt

SEQ ID NO: 53340 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggtgacgatctgccctggaatccgagcg

SEQ ID NO: 53341 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggtgctactgttttgaggacttggtatg

SEQ ID NO: 53342 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggtggaggggtgcatgttagcacatcgg

SEQ ID NO: 53343 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggtgtgattctagtacgtttggagttca

SEQ ID NO: 53344 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggttcacacgttcaagtgtttggagtgc

SEQ ID NO: 53345 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggttcccgggttttgtttgatctggtta

SEQ ID NO: 53346 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgggttggtggacgatatgattggggtcgt

SEQ ID NO: 53347 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtaagcctcccacttggtctgggtgtct

SEQ ID NO: 53348 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtacaagtcgggcaagaggctgtggcac

SEQ ID NO: 53349 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtatccttctcgacgtctgaaacgtgta

SEQ ID NO: 53350 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtcaactgatccttatcgatccctacaa

SEQ ID NO: 53351 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtcaagctgttacaatgctataccctgg

SEQ ID NO: 53352 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtcgagctgatcgttcaactaaacctcg

SEQ ID NO: 53353 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtcggattggtcaaatcgtgcgtatgcc

SEQ ID NO: 53354 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtctagtatttcggaagaggctaagtcc

SEQ ID NO: 53355 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtctgactccagtattgaggaggacaat

SEQ ID NO: 53356 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtctgggtgtgcacgtcgctactcaaga

SEQ ID NO: 53357 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgaagggcatgcgtgtatactgtggcc

SEQ ID NO: 53358 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgaatgcttcgtgggcttccctgcgtg

SEQ ID NO: 53359 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgcaccaatatatgcacgtatgaggcc

SEQ ID NO: 53360 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgcagacagatctcgaggcctagcgac

SEQ ID NO: 53361 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgcggctacactcggggtaatccatgg

SEQ ID NO: 53362 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgctaaagttggaacagtgcagtgtag

SEQ ID NO: 53363 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgctttgctaatgtacattttttctag

SEQ ID NO: 53364 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtggacatgggcattggaaaggggagag

SEQ ID NO: 53365 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtggccggacaaccgttcgacgtacgtg

SEQ ID NO: 53366 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtggggtgctctgtcggtcggtcaatcg

SEQ ID NO: 53367 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtggtaggcgaatggggcgtttcgctcg

SEQ ID NO: 53368 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgtaggtctcgctagtgcggtcctttc

SEQ ID NO: 53369 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgtagtcatggggttttcgcgtgcaac

SEQ ID NO: 53370 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgtatagtcgtaagtggggagcaggat

SEQ ID NO: 53371 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtgtggtgatcaacgtcgcttctacccg

SEQ ID NO: 53372 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttaaatcttgcttcacgtatgaggtgc

SEQ ID NO: 53373 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttaggcgcagagcgggtgctgggttcg

SEQ ID NO: 53374 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttagggcttattctaacgtgttcgcgc

SEQ ID NO: 53375 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttccaagttgtttggtgtttgtttacg

SEQ ID NO: 53376 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttggcacgggtgtttaccttcacttcg

SEQ ID NO: 53377 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttggtacggccccatttcgcgatgcaa

SEQ ID NO: 53378 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggttgtaattaaggtgtatgtgcgtttga

SEQ ID NO: 53379 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtggtttcatggagtcccggtgcatctcgtt

SEQ ID NO: 53380 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaacaattctccgcttggattttgttct

SEQ ID NO: 53381 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaacatgacacctggaagtggcaatttc

SEQ ID NO: 53382 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaagcctgggcctggggttggggctatt

SEQ ID NO: 53383 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaatagaatattcctatacctttgcatc

SEQ ID NO: 53384 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaattggggggggtaactagcatgtctc

SEQ ID NO: 53385 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaccaggcacgagttgcggtccgccatg

SEQ ID NO: 53386 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtacccggtctcccacagtgaacctatga

SEQ ID NO: 53387 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtacgggcgccagcagcgacttggagttc

SEQ ID NO: 53388 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtagaaatgctttcactaattcaggttgg

SEQ ID NO: 53389 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtagaaggacccgctgaagctctcctagg

SEQ ID NO: 53390 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaggcattcacgtcaggcctctgtcctt

SEQ ID NO: 53391 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtaggggttgccgccattggtggactccg

SEQ ID NO: 53392 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtagggttcctaagtgaggttgttcatca

SEQ ID NO: 53393 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtagtgtgactcagtccaagcgactcggt

SEQ ID NO: 53394 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatagacgccaataccgtagcttgcgaa

SEQ ID NO: 53395 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatagataagcagtgatgggcagtggag

SEQ ID NO: 53396 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatccagccgttcagagcagtgagctct

SEQ ID NO: 53397 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatccccatcgcgcatccaaagggggcg

SEQ ID NO: 53398 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatctacagacgatcagtgttttacttc

SEQ ID NO: 53399 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatcttaccagtacccgcggtgcatctt

SEQ ID NO: 53400 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtatgtgcctgtccccaatcttttctcgg

SEQ ID NO: 53401 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtattgtagccatggccaacggcggcctg

SEQ ID NO: 53402 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcaaaacagttactcggcgtgaagtgtg

SEQ ID NO: 53403 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcaaaatttaatgtgtgctcggtccggt

SEQ ID NO: 53404 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcacagttactcgctatctttgtcgtgc

SEQ ID NO: 53405 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcaccagatacgttcccgcttgtatggc

SEQ ID NO: 53406 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcacgcataagagttcaataccgtagcg

SEQ ID NO: 53407 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcaggacgcgccgatattactgttgggt

SEQ ID NO: 53408 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcatcaggatcactttggtttattatgt

SEQ ID NO: 53409 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcattaataagactggcattagcgcgtt

SEQ ID NO: 53410 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtccaactccgtgctttcagcaagagtga

SEQ ID NO: 53411 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtccgaaatgagaatctactggctcacaa

SEQ ID NO: 53412 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtccgggcaatgactccgcacgtatcggg

SEQ ID NO: 53413 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtccgtaacgactgtagctttggtgcacg

SEQ ID NO: 53414 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtccgtatgtggtgagggagcaggacaca

SEQ ID NO: 53415 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcgactagcacggcatcgccttaggcct

SEQ ID NO: 53416 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcgcatccgctcccagtcgattttgagt

SEQ ID NO: 53417 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcgccatcgttctggcactattaacctc

SEQ ID NO: 53418 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcgctttacgtttagcaagatcccggcc

SEQ ID NO: 53419 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcgggggcgatctccagctatgtgcaga

SEQ ID NO: 53420 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtcgtctcgccttggaggaggagcgcggg

SEQ ID NO: 53421 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtctgcccgagggacgatcccggttaaga

SEQ ID NO: 53422 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgaagagccgttactttcattcacttcg

SEQ ID NO: 53423 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgacaacaggacgctggggcgaggagtc

SEQ ID NO: 53424 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgacaacggcttaaggttagggtatgct

SEQ ID NO: 53425 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgacgagtcgttttacaggctatagacc

SEQ ID NO: 53426 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgaggcagccgtgtttttcattcttgga

SEQ ID NO: 53427 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgagtctggcggcgcccttctcttaagg

SEQ ID NO: 53428 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgatttgggaaaacgcttggcggttgcg

SEQ ID NO: 53429 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcaactcaggggaattgtgagaggtgg

SEQ ID NO: 53430 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcaccaggttgagcgtaaatgacctcg

SEQ ID NO: 53431 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcagacagccactagacccgaaaacgt

SEQ ID NO: 53432 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcagccggtcgctcggcataagcccct

SEQ ID NO: 53433 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcagtcatgtaagccagcatcatacgc

SEQ ID NO: 53434 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgccgctggttccttctaaatgggcgga

SEQ ID NO: 53435 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgccggagtggtgggagtgggcgggata

SEQ ID NO: 53436 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgccggtagaagcctgcccttcacgttc

SEQ ID NO: 53437 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcgaggtgaggtagctgcgttattggg

SEQ ID NO: 53438 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcgggaccgcctcatggtgttcgtggt

SEQ ID NO: 53439 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgcggggagtggttagtcgctacggatt

SEQ ID NO: 53440 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggaacccgagatattatcacgggggac

SEQ ID NO: 53441 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggaaggcacctgtgattgtgctcgtat

SEQ ID NO: 53442 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggacgtaccgatcaaccgttaaatgag

SEQ ID NO: 53443 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggatagcggtgcattccgacgaacccg

SEQ ID NO: 53444 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggccagttatgagagttgcttcgaccc

SEQ ID NO: 53445 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggcgaaggaatgggcggcctgcagtat

SEQ ID NO: 53446 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgggattgagggtgtaccgaaggagtcg

SEQ ID NO: 53447 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgggccggcggacgatgatcctacctat

SEQ ID NO: 53448 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgggcgtattcttaagtggagttgtata

SEQ ID NO: 53449 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggggttttattcatgggtaatccaacc

SEQ ID NO: 53450 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgggtaaatcactgtggcattacgtagc

SEQ ID NO: 53451 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgggtaatcttaagctgtttggaagcct

SEQ ID NO: 53452 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggtcatggttttacgggggtgtgatgc

SEQ ID NO: 53453 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggtcgtaagcgtctcccagtatctttg

SEQ ID NO: 53454 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggtgggaccgttaagcataccgtggat

SEQ ID NO: 53455 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtggttcacgtcatcttcgatgccgtgct

SEQ ID NO: 53456 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtaagtcgatctctgtacgaagaaatg

SEQ ID NO: 53457 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtacatcgttagactggtagaacctgc

SEQ ID NO: 53458 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtcctctgtctgatacccccgttcgcc

SEQ ID NO: 53459 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtcttgtttggacgctattattcgaca

SEQ ID NO: 53460 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtggcttgtttctaggcagaggtaacg

SEQ ID NO: 53461 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtggtgtgacgtgatggtcgaaaccgc

SEQ ID NO: 53462 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtgtgcatcgtgcgtctcatttcaaga

SEQ ID NO: 53463 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgttgatgtcgtcaattcttaaagtccg

SEQ ID NO: 53464 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtgtttagcgattagccgtgtgaggggtc

SEQ ID NO: 53465 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttagctgggcacaggatgacgtgatcac

SEQ ID NO: 53466 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttagtcattcctgaatcctagggtacgt

SEQ ID NO: 53467 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttatcacatgacgaaggaacattactcg

SEQ ID NO: 53468 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttcaaactcttcgcgcggtgttggatgt

SEQ ID NO: 53469 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttcccatggcaagactgtcgctcagcgt

SEQ ID NO: 53470 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttccggtacacttggggtgcatggctgg

SEQ ID NO: 53471 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttcgtacttgctgggtgcttctaccgtc

SEQ ID NO: 53472 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttctcaccctactgggtgttgatagggg

SEQ ID NO: 53473 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgcagattagattgggttatgagtccc

SEQ ID NO: 53474 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgcccttagaagattaaataccgtccc

SEQ ID NO: 53475 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgccctttcaactatagcacgcccgca

SEQ ID NO: 53476 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgcctctgcgaccccggtgcgaccgtg

SEQ ID NO: 53477 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgcgacgatttagggcatctaagttcg

SEQ ID NO: 53478 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgcttgggggcgaagcggcgacatagt

SEQ ID NO: 53479 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttgggtgagggcaagaatcacgtacggg

SEQ ID NO: 53480 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtttccgttctattcggggatacagtgaa

SEQ ID NO: 53481 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtttctacggacttctacacgattttttc

SEQ ID NO: 53482 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtttctctcaaaaggggttggcgactttg

SEQ ID NO: 53483 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtttgcgtgtatccgttaccagtgtcgtt

SEQ ID NO: 53484 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgtttgctgctctgtacgaatactatatgg

SEQ ID NO: 53485 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggtgttttacatttttcacgtttcgaccatat

SEQ ID NO: 53486 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaacataaccatcaacgtacaatagttt

SEQ ID NO: 53487 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaacgaccaggactcctggctttgcttc

SEQ ID NO: 53488 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaatctattgcgtacaagcggcagggct

SEQ ID NO: 53489 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaacatgccattactatgttcggatctgt

SEQ ID NO: 53490 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaccatttactgaattgccttccccggg

SEQ ID NO: 53491 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaacgcagcttggacgcgtgaattgcaag

SEQ ID NO: 53492 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaacgcaggggatctcctaccaccctacc

SEQ ID NO: 53493 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaacgcggcctggctgttagtgggatatg

SEQ ID NO: 53494 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaacgttgctaatccgatgtccaataggt

SEQ ID NO: 53495 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaagacacagcacgttcagctgcgaggcc

SEQ ID NO: 53496 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaagattcggtgtgccgcataagtactca

SEQ ID NO: 53497 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaggacatgaaccgactcgccgcccgat

SEQ ID NO: 53498 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaggagctgaccgtgatctctcgattcc

SEQ ID NO: 53499 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaaggcataaatgggttaacgcaggtctg

SEQ ID NO: 53500 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaagtccccctgacatgttggtggcggct

SEQ ID NO: 53501 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaatagtaaccgctctgtatcgatcaacg

SEQ ID NO: 53502 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaatgcccgcaaccaacgaatgtcggtgt

SEQ ID NO: 53503 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaattgtccatagggttcggttgcttgta

SEQ ID NO: 53504 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacacgagtagcatgtcatgtttttcgta

SEQ ID NO: 53505 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacagcagtcgaatctggacagtcttagt

SEQ ID NO: 53506 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacatggtccctgttgagctgaatctttg

SEQ ID NO: 53507 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacatggttatagcatataggcggtgcgc

SEQ ID NO: 53508 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaccgacggtggaccttgcatccactctc

SEQ ID NO: 53509 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaccgcataaaactaacacgacggtagtg

SEQ ID NO: 53510 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaccgcgggggaagctgtttgcctagccc

SEQ ID NO: 53511 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacctgtcggttgggcaaaataattggtg

SEQ ID NO: 53512 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacgatatcatttctgtgctgctgtaggt

SEQ ID NO: 53513 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacgatcctacgggcagggaattctagca

SEQ ID NO: 53514 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacggtccgtgcaaacgttgtgacacgtg

SEQ ID NO: 53515 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacgtattatgttttattaggcggtttag

SEQ ID NO: 53516 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacgtggagccgtgtcagcggggatcgtg

SEQ ID NO: 53517 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacgttacttactttgatatcgaatcttg

SEQ ID NO: 53518 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttactggatttgtattcgcgagcgtccctt

SEQ ID NO: 53519 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttacttgcgattaggctgatcagatactga

SEQ ID NO: 53520 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagacgcgccggtttgctaacatctaggc

SEQ ID NO: 53521 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagacgcgttgagtacggggcggccactt

SEQ ID NO: 53522 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagagagggagggcggacgcttcatgtcg

SEQ ID NO: 53523 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagagattggagcacacacaacgaatcaa

SEQ ID NO: 53524 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagaggccagttgtcgttgggatatagca

SEQ ID NO: 53525 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagagtactgaaggagccgctcaggggga

SEQ ID NO: 53526 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagatcttgcaggtgccttatgcaacccg

SEQ ID NO: 53527 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagcaaacatgcctttggtctcaatagca

SEQ ID NO: 53528 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagcataatcgtcgccgggcctgcaggga

SEQ ID NO: 53529 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagcatgctttttactggctcttcgcctc

SEQ ID NO: 53530 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagccaagggatgcacgttgagaaatcgg

SEQ ID NO: 53531 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagcctaacgggatgcttatcgcattatt

SEQ ID NO: 53532 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagccttgtgttgtatacgcgctggcgag

SEQ ID NO: 53533 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagctaggacacgcatggggactaatcgc

SEQ ID NO: 53534 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagcttctgtatcatcccccatccgtttg

SEQ ID NO: 53535 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagcttggtcccgccaatttaaggcgtca

SEQ ID NO: 53536 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaggatctacaaggtacttcgttacatgc

SEQ ID NO: 53537 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaggatttgcatatacaacggcgtccttc

SEQ ID NO: 53538 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagggaccttgtcttgtttattgttgacg

SEQ ID NO: 53539 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagggcgcacggttacgcaaagagccggg

SEQ ID NO: 53540 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaggtgcactcaggtgttgagactccggc

SEQ ID NO: 53541 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttaggttatgggtagagctatgccacctcg

SEQ ID NO: 53542 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagtaagccgacgaggtctaagagcgttc

SEQ ID NO: 53543 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagtctcactgaccgtggttcagcctgct

SEQ ID NO: 53544 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagtgtaaattttgtattggtccttggtg

SEQ ID NO: 53545 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagtgtaccggaccgcatatccctgtcac

SEQ ID NO: 53546 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttagttggccacttcagtccgtccgttggt

SEQ ID NO: 53547 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttataacggtcaccactggtcctgtgttgg

SEQ ID NO: 53548 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatattatcatcttagttccaggttggat

SEQ ID NO: 53549 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatccccgtactacattactcacgaatgt

SEQ ID NO: 53550 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatcgggaacgaggttgtcattatgggtt

SEQ ID NO: 53551 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgcaagtgtccctcgaggcaggccagc

SEQ ID NO: 53552 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgcaatctggcgctgtcctctgcacat

SEQ ID NO: 53553 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgccgtagggtgtgttacgtgcgttcg

SEQ ID NO: 53554 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgcggaattcgcagacccaccatggac

SEQ ID NO: 53555 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgcttcggcaatggcttcaggtgacgt

SEQ ID NO: 53556 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgcttcttatactatctacggactccc

SEQ ID NO: 53557 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatggtagtgtgcggaaacctgcctcggc

SEQ ID NO: 53558 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatgtcacgtgataggtgctatttcaaac

SEQ ID NO: 53559 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttattcatgtgggcaaacaagagtatggac

SEQ ID NO: 53560 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttatttctcaatgttaattagacttgcctt

SEQ ID NO: 53561 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaaagcacatggggtaattgatgtccgc

SEQ ID NO: 53562 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaaatcaccatgggtcaatgtctgtact

SEQ ID NO: 53563 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaacaataattcgatttggctccgtata

SEQ ID NO: 53564 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaacgcacggcagtccagtatatacatt

SEQ ID NO: 53565 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaagcaactggtttttaaatggaccgac

SEQ ID NO: 53566 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaaggacgcacagtctcgagttactcgt

SEQ ID NO: 53567 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaaggggcaagtaaggcgttcgggaaat

SEQ ID NO: 53568 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaagggtaagtgcctggtctcacggccg

SEQ ID NO: 53569 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaccagttatgcggcgaaatggcacccc

SEQ ID NO: 53570 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcacgacttaccggcagtagtaggatgcg

SEQ ID NO: 53571 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcacggcggatgaggatcgcggaccggtg

SEQ ID NO: 53572 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcagaatcgagcgagacatccaacgttgg

SEQ ID NO: 53573 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcagatcacttagtgcttgcaagaccata

SEQ ID NO: 53574 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcagcagactatttcgtgccggcgcatgg

SEQ ID NO: 53575 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcagcattaccccgccttactcggcacgt

SEQ ID NO: 53576 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcagcgaggtgttgcattgtttagtcgtg

SEQ ID NO: 53577 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaggtggttgacgtggtacgtttgcgac

SEQ ID NO: 53578 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcaggtttgcccggacgagcgttagccga

SEQ ID NO: 53579 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcagtttagcattaattttagttcttccg

SEQ ID NO: 53580 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcatgcggcgatcgaacagttctgacggg

SEQ ID NO: 53581 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccactcttatttgacgagtagatacgat

SEQ ID NO: 53582 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcccacgcatgattgcctcgagccactcc

SEQ ID NO: 53583 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccctcgccgggatcagtatcggtcactt

SEQ ID NO: 53584 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgactaggatttcgaggatcttaatat

SEQ ID NO: 53585 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgactcgatgcttgctcgtgaacgggc

SEQ ID NO: 53586 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgattaggccgtttgttgtgatatcgg

SEQ ID NO: 53587 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgcaaagtgtgatgcagctgctctcgt

SEQ ID NO: 53588 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgccttgaggtcgtcgcggggacacgc

SEQ ID NO: 53589 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccggcgtggaatcgctaaatcttggtga

SEQ ID NO: 53590 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccggctcccgaaatagctagtctccatt

SEQ ID NO: 53591 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgtatcggtatcataaagcttgtcagg

SEQ ID NO: 53592 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttccgtcctaccgggcctcctctgcttgtt

SEQ ID NO: 53593 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcctggagtaaattgacggtagatgacgg

SEQ ID NO: 53594 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgacagcggcccatgtctttcctttcgc

SEQ ID NO: 53595 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgacgcggttccttcctgcacattatgg

SEQ ID NO: 53596 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgacggtccttcgtgcatctcgggtccc

SEQ ID NO: 53597 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgagcgtacccggtgttttcctcgggag

SEQ ID NO: 53598 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgagtataaggttgggtgttgcctcacg

SEQ ID NO: 53599 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgcgcacttacgcgttgtctggtcgtac

SEQ ID NO: 53600 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcggacacgataccctctaccgggctact

SEQ ID NO: 53601 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcggagaattataggctgcggcggtacgt

SEQ ID NO: 53602 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcggaggagcactgttgtgtcagactgag

SEQ ID NO: 53603 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcggcagctcaagtttaggtctgacgtga

SEQ ID NO: 53604 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcggcgcaaggcggctttacaagctcatg

SEQ ID NO: 53605 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgggcttggtgatccggttgcaggtgtc

SEQ ID NO: 53606 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgggtcaacattcacagtaataatgctc

SEQ ID NO: 53607 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgggtgagtcggtaaaatcttagctcct

SEQ ID NO: 53608 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgggttatgctcatgttacactacagca

SEQ ID NO: 53609 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgtataccttaagcgcggtacctcgcgg

SEQ ID NO: 53610 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgttggcttgtcagacggcggtccacac

SEQ ID NO: 53611 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcgtttctgtaaccaccgcggctcgttcg

SEQ ID NO: 53612 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctaaatggcgaccacaggtacgacggtt

SEQ ID NO: 53613 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctacaacgtacgcctcttctgtgaccca

SEQ ID NO: 53614 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctaccgcactggatgtgccaattgatgt

SEQ ID NO: 53615 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctagcatgctgtttccacataacgggcg

SEQ ID NO: 53616 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctcccattattccacgcggggtaacggc

SEQ ID NO: 53617 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctcgtggtgggggtcttggatggcaccg

SEQ ID NO: 53618 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctgaggctgggtacggacggtcagtgta

SEQ ID NO: 53619 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctggcccaaaggctgtctgggtgctggg

SEQ ID NO: 53620 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctggcctgcgaacgagtgaccgttgcgt

SEQ ID NO: 53621 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctggggttcactgctcctttcgatctcg

SEQ ID NO: 53622 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttctgtctgtattacggcagcacatgagcg

SEQ ID NO: 53623 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttcttgccgggaagtatcaattggggcaag

SEQ ID NO: 53624 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgaaggcatgtaaggagtaacgcgtcgat

SEQ ID NO: 53625 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgaatcgccgttttcgccttcatttgacg

SEQ ID NO: 53626 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgacaaggtatgcgttggtatcgtgggat

SEQ ID NO: 53627 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgacctaagctataacattgctacttcgt

SEQ ID NO: 53628 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgacgtgtcgattgaattgaacttagtat

SEQ ID NO: 53629 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgacttactcttacgcaacagcaggccgc

SEQ ID NO: 53630 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgagcggtctcttaccttgcagtgggggt

SEQ ID NO: 53631 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgaggagattagggcgaattttgcgctat

SEQ ID NO: 53632 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgagtaggcgcagtgcacttaagcacacc

SEQ ID NO: 53633 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgagtgaggtactcacatggtagttaact

SEQ ID NO: 53634 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgatacccgcggggacgttacatggatag

SEQ ID NO: 53635 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgatcgtcgttttggtaggggcgaagttg

SEQ ID NO: 53636 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcagtgttagaccgccatggcctaggcg

SEQ ID NO: 53637 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcagttgccacgctgtagtttgcgaccc

SEQ ID NO: 53638 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcatagggcagcgataggcaaggtgctg

SEQ ID NO: 53639 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcatgtacgtgtttagtagcatctacaa

SEQ ID NO: 53640 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcatgtagccacgtccagatcacactgg

SEQ ID NO: 53641 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgccgcacacgttttggtccctgtcgggc

SEQ ID NO: 53642 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgccgctctgtcggtgtagtaggcctttg

SEQ ID NO: 53643 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcctcctgggcctcatttatgcgcggat

SEQ ID NO: 53644 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgaagtgagaatgggcggctcagtcgg

SEQ ID NO: 53645 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgagcacagcggccctcccctcaggct

SEQ ID NO: 53646 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgattccacgggcccgcgcttcctttg

SEQ ID NO: 53647 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcggacgcgatcggggcagcaaggcgac

SEQ ID NO: 53648 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcggatcatgtttcagcccggcccgatt

SEQ ID NO: 53649 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgggcgccataagaagcgtcttcggtg

SEQ ID NO: 53650 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgtacatcagagcgcgataacacttcg

SEQ ID NO: 53651 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgtcttttctcttgtggccgcggtctc

SEQ ID NO: 53652 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcgtggattgacggtgatattttggcct

SEQ ID NO: 53653 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgctgacataactttgttcagtttttgga

SEQ ID NO: 53654 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgctgacgtgcaaaaggcagttggagcta

SEQ ID NO: 53655 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcttaaagctccgcaatccaacgcttca

SEQ ID NO: 53656 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgcttctgcgactgcattattggtcttgt

SEQ ID NO: 53657 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggagggtggcccttgtgacaggttccgt

SEQ ID NO: 53658 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggatgatcggtggttggttggcaataat

SEQ ID NO: 53659 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggcgcaagttgttggcgggtcggcttgt

SEQ ID NO: 53660 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggcggtgacatcgacacatgaggaggcg

SEQ ID NO: 53661 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggcgtcccgattaagtgtttcgcgtggg

SEQ ID NO: 53662 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggctatgtagggggccgtatgttattgc

SEQ ID NO: 53663 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggctatgtgatgctccagttgttgcgga

SEQ ID NO: 53664 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttggctctaccatgcgtacatggcaggcac

SEQ ID NO: 53665 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggatccgcgcctcgttgtagatcctgc

SEQ ID NO: 53666 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggatcctagttgtgtggcgaaattggt

SEQ ID NO: 53667 - DNA, 32 bp, Artificial Sequence
  Synthetic oligonucleotide
  source (1)..(32): /organism="Artificial Sequence" /note="Description of Artificial Sequence: Synthetic oligonucleotide" /mol_type="unassigned DNA"
ggttgggcaggtattatcgaagacataccggg
